United States Patent 10,233,495 (METHODS AND COMPOSITIONS FOR SCREENING AND TREATING DEVELOPMENTAL DISORDERS) - sequence listing, part 162

SEQ ID NO: 940 - DNA, 51646 bp, Homo sapiens
atatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtggcactgggcttcctttctggagggactgtggcaccatgaaaagttactgtttgttgaaactggcagtgttttagaactttctaactttgggacacttcttcaagttcatcagagcgtgttgcatgtaacagtgagataagctgtatcattggctgactgatgctggtgaattcacagctaagcctcccaagcctgctggcttcagctgacaaagggttggaagccaggcgtgaacatgcagctggagctgaagctctgcttggcatctgcagagtgagctttccttgtcaggcctggcctggcaggtgtctggagggtctgagaggagagacactctggagggacgggttggcaggtgggagctgtctgccaaggacatccagaaggcagcagatgtgggggcagctgctaaggcctgcagcaccccaagtgggttacttggtccatactaagatatggaattaattattttgttgtggttgctgttgtttcttgcttttttttttttttttttgagagaaggtcttgctctgtcacccaggctggagtacggtggtgccatcatggctcactgcagcctgcacctccaggactcgagcaattctcccaactcagccttccaaatagctgagaccacaggtgcatgccaccacacctggctgtttttttttctattttttgtagagatgaggttctgacatattgcaccaggctgatctcgaactcctggcctcaagcgatcctcttcagcctcccaaattgcttggattataggcatgagccactgcacccggtcttggaatgaattatctaccaactatttaagacactggtagtagttctgcggaagatttttatgggttctgtaaaacaaaaagggttctgtatgttaatgttactctatgatccttgattttaatgagccttatgaatgtgagttgaggggctgtggaatgcaacatctcccaataactgaccacaggacctgttttaccagcaacaggtatcaatttcttatggcatccagtttgggaaaggttgatttaagctaaagagaaaggaagatatgttatagaaagctgtgtcctgaaaagtatttttagttgattagagcaagctaaaaatgctttgtgcgctggtatgatggctcacacctataatcctagaccctgggaggccaaggcaggcggatcacttgagaccaggagttcaagaccagcctggccaacatggtgaaaccccatctctactaaaaatacaaaaattagccaggcatagtggtgtgtgcctgtggtcccagctactcgggaggctgaggtgggagaatcaccggagcctgtgaggtcgaggctgcagtaagctgtgattgtgccactgcactccagcctgggcaactgagaccctgtctctcaatcaatcaatgaataaatgcatgcttcatgagcaaacatggcaggatctggcataagagccctcagacatcaaggacttccctcccacccaaatacccattgccaagggagcctggttgggggtgtctgggtcaggcctgtgtgtgtctgagggcatgaaggaggtaggaaggtgctgctggtggtggatggcttctgtccagggtaggagctaacacagagataggtctgaatggtgaaactccctttggcctggcctctcaatagtgtgggttaggctgatcttgaactcttagcctcaagtgatccttcctcctcagcctcccaaattgcctggacaacatggcaaaacctcatctctaaaaaaaaaaaaaaaaaaaaaaattagccaggtatggtgatgctccctccctccctcccttcggcaattaaggagggagccctaattgccaaaacctgccagaaaaagaagtttgttttcctatttttctctcttttcatagagtcttaagtctactcattttctttctattctctttgtatttgttaaaaatggcattataatagcattcatcatcaaaataaaatatcctctcacacacaggcagccctgccacctggtcattttgactgcgtgaatctcttgcaggtcttgcccataaagggatgcattttcctttcactgtaaataaagcatgggtatggttctatgtattaattttttcatttactgtatttttatttttttatgtgattgcaccatcctcataatcataattctgattacttaacatctttttcaagtgagtatgctctaatttaggcattttaaagctatttatgtaaataatgcaggtaaatatccttgtgcttttcattcttaggattctttttttgaaagaaatttgtagaagtaaagttgcttagtcaaatggtatggtgctttatggcatttgcggccttttgcctgggctgttgggttgcatatcttcttctgagatgcgatgtgaggttttgggatggtgcccttgattggtggccttggaataaggggggaggtgaggatccagtttcgtttcagcctgatggagcctcctgggtctggttctttgtgctgttccagactttctctcccctgtcacctcctttgatggcctccagcttcccccctctctgctatcaagacatggaaatccccacaggcagctctgttcctcttcctttttgcagaggccaggcctcgctgtcttgatgtctgctccccagacagttgtgtgttgacaggctgttccccaccagctccctcccactcctctcatcagggagtggcaggtccttgggtctcagagttaagggagccacagacctcactctgattgcctgttgctagcctgctttcttccttcctgtctgtgtcatgacttagtcccacatgccactcagactcagagcagcaagccctcctcaggcaccggaaatctctctggtacctagaattatgccacttagagctgagagggccttagagaccacttagttcaatccctttatctcacagatgagaacattgtgaggccggagaatgactgtcccaagatggcctagtgtgttcccctcccctgtagctgcacttctccctgctggacagcagcagggctctgtctcatctccattcttgtctgtctggtccacaaaaccacttctctctttaaaccaactttaaagaaactgtggtcataggtagatgggaaactcctcttccagagctgctcccaacgagggtggcttgtcgaaaagggtgcagtattaatccattccacaagtgttatgctggggactgtgaggagcccctgcccggacacatacgtggacaaagagaagcagcacagcatggtgggtgaggggacagaggcaggaaccaggtgcctgggttcagatccctgagctgaggatcagagaggaaagggatgagagagaaaggctgagaacagcacaaatctctgctgacttattaaaagtgtgaccctgggcatgttagctctctatgccttcattttctcatctgtcaagtgggaataataagattaactgagttaataagtatgaagttctttgcagagtatatatatgtatgtatacatatataaaatatatattatatataatatatattatatataatatatattttatatatatatatatattttatttttaaaattgagacgaggtctcaccctgtctcccaggctggagtgcagtagtacgatcataactcactgcagcctcaacctccctggctcaagagatcctcctgcctcagcctccctagcagctgggattacaggcatgcatcaccatacctggctaattctttaaatcttttttagggatgaggttttgccatgttgtccaggctggtctcaaacttctgggctcaagcagtcctcttgccttgacctcccaaagtgctggtattacaggcgtgagccaccacacccggccccagagtatactttttttttttttttgaggcagagtcccactctgttacccaggttggagtgaagtggctcaatcttggctcattgcaaccttcacctcctaggtttaagcaattctcttgcctcagcctcctgagcagctgggattacaggtgcctgccaccacgcctggctaatttttttgtatttttagtagagacgtggttttgccatgttggccaggatggtctcaaactcctgacctcaggtgatctgcccgcctcagcctcccaaaatgctaggattacaggcgtgagccaatgcgcctggccagagtgtacatattaagtgctatacaagtaattgcaaaaaaggaaagaaataaggaaatgaagaaagcaagcaagcaagaatgaaacccaaccaaccaagcaggtggttgaggccagtgactgttagtaaggaatcagtatgcgaggaggtggatagagaaagcttctttgagggagtgagttttcagctgggtaaagagtgttctaaaacctttattttatttgctgtgtcttgttaggaggttccagagggtttggaactgcaatagcagattctttctcttcagcaaaaggccttgatttatgtaatgaagaatgcagctttggatttcccagggctctgctgtaatcttgtgcgaccttagctgttaaagcctctgtgaagtgggggagtgaggtttgattattgttgcagctataacagtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccaggtgggcctggccctcacttcagtgccttctcttccccggtgctggtgactcagggcatcctgcaattcatgcttgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttccaggttctcccagtggctgccatgggccaaacctagccagaatcctgctggcacacttgggaaacacaggagaggatgaggaatggatctgagggcaaacaggcccaggagcagcgcaagtgctatgaaagagatgaataaggatgagatggggttaggggagagaaaggccgggaaagagagagaaaaaatccttttttagactgggaagtcagggaaggcctctccaaggagatgacatcttagcggatgcttcagggtataaagaagctagctatgtggccttccagatagaagaatcagctagggcaaaggccccccagtttcttccagaaggcccatgtggttagaggtctgttaaaggaagaagtgctgtgaccagggctggaggacttgtggggcccagatcagactggccttgtgctccctgataagaagtttggattggagtctaagtgaaatgagaagccctcatcctttcacagtttatctcaccctgggctttatcagattttctgcctgcccggtaccctgcaaacatcaatagttgacatggtagacctttgagccctctccgacctagtctgtgatcacactagatactgcctcagttttaaaggcaagtcttttcctttcttggttgtgtagaagctcgcattttcttaactcgtttggaaagaagtaaaaagttgactactggtgtaaaggcaagaacagagcttcaccactcataagaccagtgctttccttccttgaaaggatggtgagcccataaaggcaggagtcactggtgccattggttaacctctgagtgccagccttgtgttggataaggtggggtggccccagccccagcagtgtgctcatccctggagggtcaagaagagtatgactgtagagaccctcattcacactccgtgggtggaacagaagggctgacttcatcaagtgaatggtctgcagggccttctgtgtgttatgaattgagcatttgagacccttaacaatgagaggaaaagaaatcctggcattttttattactaggaacaataagtttctggaaccagtttccactacagagtgacactgggcctgacatctgctgaagcgactgtgctcttctcaatgcccagactcagggcaaaatggaagctttcttactctaagtcttaatggtgctctgtggtttccagaaattcccctgcaaacttctctccaaaaactttgttctgtccttgcctaggttatggtgtcttagtttgcatctgtctgcgccatttgactagacgctccttgaggactggatccattgtggaacttagttggtgggcagtggatgtctggcagaggaagacatcctgcctccccattgccaccatggacactacatcagggtggctgcaacttcttggacctctgtgttctgccactcactgtcatgctctgtgactttggggaaattaggaaacctctctgggcctcagcctcgtcctcatctataaagtggagatgctaacagctaccttcatggggtgttgtgaggaatgagggaatccacaggtaaaaggcttcggacagtgtctggttatagtgcatcccgagtaaatataagtgatttctctgacttcctgctgctgagacagggaacaatagcagctcctgccattgaatacttactatgggctaagtactagcctgtgtaggttggattcattctttaattctcacatcgagcttatcaaatggatattcttagtattctgattttgcagattagggaacgaaggctcagagaagttgaatttactttcacaaagacacatagtgagtaaatgacagagcaagaactagagcccatatcttttgaatctagaccccacacttcaaccataaggctatcccctcttcaggtaggggtggagtcttcggttccctggtctgtagaccctggaatgacactaggtgctgctccctagaatgtaattgttgcttctaaatgaaatggagggaaactggtcaaagctcccgctctgtccatcggcttctttcctgaaaaaaagcttggtccctggactgtcagatgccccagcatcctcctctggggtctgcccatacccaattttgtcttttagtttctcttctcactagaggtgcctttatatgtaaatgttcgaaagttaacattttcatggaggacaccctctccccagctccctctttgtctgtggcacctcccatcccatctcctatttattcttactttacacagaattctataatctggctatattgtttcttatcccgtggcagatttaaagaagcaaattagaagcagggagagagacttctacaggcagggtcacagaggtgatgtgtggtgattataagcctgggctttggggtcagacctattgggttcaagtggcagccctgtcacttactactgaatggccttggtcaaagctcttgactgcctgagctggtttcctaaactgcaaaatgagaataataaaaggacataccttgtgagaattaaatgagcgaatacacaaaaaatccttagcgcagtgcttggagcaccattaatgttcctgttttgttattgttgttattagacagtcaacagtgagagaggaaacaaaataattatgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggagtttttttttttttttttttttctgtaccccagtggcgcctggagcgccagcaagacagaatcattcactcccctggaaagggggctaaagccagggagccaagtggtctggcttggcaggtcccagccccatggagcccagcaaactaagatccactggtggccaggcgcagtggctcatgcctgtaatcccagcacttagggaggccaaggcgagtggatcacctgacgtcaggagttcaagaccagcctggccaacatggtgaaacctcatctctactaaaaatacaaagattagccgggcgtggtggggggcacctgtaatcccagttacttgggaggttgaggcaggagaatcgcttgaacccaggagaaggaggttgcagtgatctgagatcgcaccattgcactgagcttgggtgacaagagcaaaactccgtctcaaagaaaaaaaaaaaagatccactggctcaaaattctcactgccagcacagcagcagtctgagatcaatctgggacactcaagcttcgtagggggagggtcgttggccattgctgaggcttgagtaggaggttttaccctcacagtgtaaacaaagccaccaggaagttcaaactaggtggaacccaccgcagctcagcaaagctgctgtggccagactgcctctctagatttcttctctctgggcagggcatctctgaaaaaaaggcagcagccccaatcagggacttatagataaaacccccatctccctgggacagagcacctgggggaaggggcagctgtgggcacagcttcagcagacataaatgtccctgcctgacagctctgaagagaccagcagtcctcccagcacagcgttcaagctctgctaagggtgagactgcctcctcaagtgggtccctaacccccgtgtatcctgactgggagacacctcccagtaggggccgacaggcatctcatacaggagagctctggctggcatcaggcaagtgcccctctgggatgaagcttccagaggaaagaacaggcagcagtctttgctgttctgcagcctccactagtgacacccagccaaacagggtctggagtggacctccagcaaactctagcagaggggtctgattgttaggaggaaatctaacaaacagaaaggaatagcacatctaatcagagaccacatccgaaaatcaccagcatcaaagaccaaagatagataaatccacgaagatggggatgtaaaccagtgcaaaaaggctgaaaattccaaaaaccagaatgcctcttctcctccaaatgatcacaactccttgccagcaagggaaaaaaactggacagagaatgagtttgaccaattgacagaagtaggcttcagaaggtgggtaataacaaacgcctctgagctaaaggaacatgttctaacccaatgcaaggaagataagaaccttgaaaaaaggatagatgaattgctaactagaaaaaccagtttagagaagaacataaatgacctgatggagcagaaaaacacagcacgagaacattgtgaagcattcacaagtatgaatagctgaatcaatcaaacggaagaaaggatatcagagattgaagaccaacttaatgaaataaaataagaagacaagataagaggaaaaaaaatgaaaaggaatgaacaaagcctccaagaaatatgggactatgtgcaaagaccaaacctacgtttgatggatgtacctgaaagtgacggggagaatcgaaacaagtggaaaacactcttcaggatattatccaggaaaacttccccaacctagcaagacaagccaacattcaaattcaggaaatacagagaacaccacaaagatattcctcgagaagagcaaccccaagacacataatcgtcagatgccccaaggttgaaatgaaggaaaaaatgttaagggcagccagagagaaaggtcaggctacccacaaagagaagcccatcagactaacagcagatctctctgcagaaaccctacaagccagaagagagtgggggccaatattcaacattcttgaagaaaagaattttcaacccagaatttcatatgcagccaaacaaagcttcataagcaaaggagaaataaaatcctttacagacaagcaaatgctgagagattttgtcaccaccaggcctgccttacaagagctcctgaaggaagcactaaacctggaagggagcaaccggtaccagccactgcaaaaacataccaaattgtaaagactatcaacacttcgaagaaactgcatcaactaatgggcaaaacaaccagctagcatcatgatgacaggatcaaattcacacgtaacaatattagccttaaatgtaaacgggctaaatgccccaattaaaacacacagactggcaaattggatgaagagtcaagacccaacagtgtgctgtattcaggagactcatctcaagtgcaaagacagacataggctcaaaataaagggatggaggaatatttaccaagcaaatggaaagaaaaaaaaaaaagcagaagttgcaagtttaacctctgataaaacagactttaaaccaacaaagatcaaaagagacaaggaagggcattacataatggtaaagggatcaatgcaacaagaagagctaactgtcctaaatatatatgcacccaacacaggagcacccagattcataaagcaagtcttagagacctacaaagagacttagactcccacacaataataatgggagactttaacaccccattgtgaatattagacagatcaacgagacaaaattaacaaggatattcaggacttgaactcagctctggaacaagctccaacccaaatcaacagaatatacattcttctcagcacctcatcacacttactttaaaattgaccacataattggaagtaaaacactcctcagcaaacgcaaaagaatggaaatcataacaaacagtctctcagaccacagtgcaatcaaattagaactcaggattaagaaactcactcaaaaccacacaactacatggaaactgaaaaatctgctcctgaatgactactgggtaaataaggaaatgaaggcagaaataaagatgttctttgaaaccagtgagaacaaagacacaacgtaccagaatctctgggacacatttaaagcagtgtgtagtgggaaatttatagcactaaatgtccacaagagaaagcaggaaagatctaaaatcaacaccctaacatcacaattaaaagagctagagaagcaagagcaaacaaattcaaaagctagcagaagacaagaaataactaagatcagagcagaaccgaaggagatagagacatgaaaaactcttcaaaaactcaatgaatccaggagctgttttttttttgaaaagatcaatgaaataaatagactgctagcaagactaacaaagagaaaaagagagaagaatcaaatagacacaataaaaaataataaacggggtatcaccactgatcccacagaaatacagactaccatcggagaatactataaacacctctatgcaaataaattagaaaatctagaagaattggataaattcctggatgcatacactctcccaagtctaaaccaggaagaagttgaatccctgaatagaccaataacaagttatgaaattgaggcagtaatgaatagcctaccaaccaaaaaaagcccagaaccagacagattcacagccaaattctaccagaggtacaaagaggagctggtaccattccttctgaaactattcccaacaatagtttggagctggtaccattccttctgaaactattccaaactcattttatgaggccagcatcatcctgatgccaaaacatggcagagacacaacagagaaaatttcaggccaatatccctgatgaacatcgatgtaaaagtcttcggccgggcgcggtggctcacgcctgtaatcccagcactttgggaggccgaggcgggcagatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtcctcaataatatactggcaaaccaaatccagcagcacatcaaaaagcttatccaccacgatcaagttggcttcatacctgggatgcaaggctggttcaacatatgcaaatcaatcagcgtaatccatcgcataaacagaaccaatgacgaaaaccacatgattatctgaatagatgcagaaaagtccttcaatataattcaacaccccttcatgctaaaaactctcaataaattaggtattgatggaacgtatctcaaaataaaaagagctatttatgaaaaacccacaggcaatatcatactgaatgggcaaaaactggaagcattccctttgaaaactggcgcaagacaagtatgccctctctcaccactcctattcaacatagtattggaagttctggcaggggcaatcaggcaagagaaagaaataaagactattcaaacaggaaaagaggaagtcaaattgtctctgtttgtggatgacatgattgtatatttagaaaaccccaccatctcagccccaaatctccttaagctgataagcaacttcagcaaagtctcaggataaaaaatcaatgtgcaaaaatcacaagcattcctgtatactaataacagacaaacagccaaatcatgagtgaactcccattcacaattgccactaggagaataaaatagctaggaatccaacttacaagggatgtgaaggacctcttcaaggagaattacaaaccactgctcaaggaaataagaaaggacaaaaacaaatggaaaaacattccatgctcatggataggaagaatcaatatcatgaaaatggccatactgcccaaagtaatttataggttcagtgctatccccatcaagctaccattgactttcttcacagaattagaaaaaaactactttaaatttcatatggaaccaaaaaagagcctgtatagccaagacaattctaagcaagaagaacaaagctggaggcatcacgctacctgacttcaaactatactacaaggctacagtaaacaaaacagcctggtactggtaccaaaacagatatatagaccaatggaacagaacagaggcctcagaaataacaccacacatctacaatcatctgatctttgacaaacctggcacaaacaagcaatggggaaaggattccctatttaataaatggtgttgggaaaactggctagccatatgcaaaaaactgaaactggactccttacaccttatacaaaaattaactcaagatggattaaagacttaaatgtaagacctaaaccataaaaaccctagaagaaaacctaggacattcaggacataggcatgggcaaagacttcatgtataaaacatcaaaagccatggcaacaaaagccaaaattgagaaatgggatctaattaaactaaagagcttctgcacagcaaaagaaactaccatcagagtgaataggcaaccttcagaacaggagaaaattttttcaatctatccatctgacaaagggctaatgtccagaatctacaaagaacttaaacaaatttacaagaaaacaaccccatcaaaaagtgggcaaaggatatgaacagacacttctcaaaagaagacatttatgcagccaacaaacatatgaaaaaatgctcatcatcactggtcattagagaaatgcaaatgaaaaccacaatgagataccatctcacgccagttagaatggcgatcattaaaaagtcaggaaacaacagatgctggagaggatgtggagaaataggaatgcttttacactgttggtgggagtgtaaattagttcaaccattgtggaagacagtgtggctattcctcaagaatctagaactagaaataccatttgacccagcaatcccattactgggtatatacccaaaggattataaatcattctataaagacacatgcacacgtatgtttattgcagcactatccacaatagcaaagacttggaacccacccaaatgtccatcaatgatagactggataaagaaaatatggcacatatacaccatggaatactatgcagccataaaaaagatgggttcatgtcctttgcagggacatggatgaagctagaaaccatcattctcagcaaactaacacaagaagagaaaaccaaacatcgcatgttctcactcataagtaggagttgaacaatgagaacacatggacacagggaggagaacatcacacactggggcctgttggggggtgaggggctaggggagggatagcattcggagaaatacctaatgtaggtgtcaggttgatgggtgcagcaaaccaccatggcatgtgtatacctatgtaacaaacctgcacattctttacatgtaccccagaacttaaagtataattaaaaaaagaaaaaaattaggatatagagggaaaaattttattagttgaaaaatttggctatctaggacagccgcttccctagaatgttttgagtgaaattgagaaacatatgtgctttatgaattgagcatagcacagctaaagtgttgctaagtcacttcattttatgaaacttgtgaaaataagaatggggaactttttaaacattcaggatcattgacaaaggagcttcatttgaaatagtcaatctatccccttttaaagttagggagagattgggctgggcgcggtggctcacacctgtaatcccagcactttgggaggctgaggcgggtggatcacctgaagtcaggagttggagaccagcctggccaacatgtagaaaccctgtctttactaaaaatataaaggttagctgggtgtggtggcacatgtctgtaatcccagcaactccggaggctgaggcaggagaattgcttgaacctgagagtcaaaggtttcagaaagccaagatcaccccactgctctccagcctggctgagggagggagactctgtcttgaaaaagaaaaagttagggagattgggaagccgaggtgggtggatcacttgaggccaggagtttgagaccagcctggccaacatggcaaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggagatgagtggagattacagtaggccaggaggggttgtggggaagggaggatggagaaagaaggggcaggtttccagaggagctcagggagagacagagggtggggctgtgagttttcacacctgattggctgcaaagtgttagaatcaaagttacacccacctggccaggatgctggtcatctggctgcatatgcggagtgagtgatctctgtgcgcccctgctctctctgtagggacccctgttatagtgcccatcgtgcagcatatttctccagataggctgggacctctggtctcaagtacagggaaggtgtcagcccctcttagttccctccttagatgggggtcccaattccaggtgagccaatgcaggggcagcgtgagcagcagcagtgtgagcctatggaagtggaggatgcctgtcccgcctgatggcattcagattcccagtgtttgcaaaactctgtgctggtttgtgacttctgattccaacctttattttagcgtaacaattctcatgtggaggggctgccagaatgagctgagtgtgcgtgggggaggagttcaaaccagcctccatgttctgaaatgtcccccctctgaccccattgctccactgctcccacccctagtctggattaagtgtctcctctggggtcccaaaatatccagggcatctcattacaccaaccacactgtatgataatctgtggaactgtctgggttcatctcagccatcacagtcggcccctggaggcgggagttatatcttatctactcctctacacccagggcctggcacacagtagtttattgaatgaagtggggtccacgtgtggcccccagctcatagtacacatatgagagcctggtgaaaggttggctccagtgcccctccctgcctagtagtcatctggacagaccacacagggcagtgggcttcagatggcccctggtaagatgctggctattctctaggagagcaaggtgggcctgaagggctcctcactttagcatttgagtgctatatagggaaggccctgggagcctgattccccagagcggaggagggctggggagtggagcagagtaagggaggggacttagtgactgtcaggggcaaccaagggccatagagcaggtggagcaccagacaggtgctgggaggtaagatgctgtaacaacagcccaggtgacctgatcaactctttgtcttgtgggcctggttagcaagaatgtccttgtgcgtcaagaggataaatctatttcagggatgacaaaactgctcctggccctttgagccctcaggcttggcctggagctggtgtcctcacagccccacactctgctggctccttggcaggagtgtgcttctgccaggtgcaagtgtgggtgggggaaggagggggtgtgccagctgtagcccagcaaatgctggcgccccaggggctagtgcaaggtgcagcaggtgagatagtggacagacagaccttggcccatcagaaggaagtgctttctaacaggggcaccagatcagttttgttcatacacacactcatagacacactcactcactgtattagtttgcactgctataaagaaatacctgagactggtaatttataaaataatgaggtataattggctcatagttctgcaggctgtacaggaagcatggcagcatctgcttctgaggaagcctcagggaactttgactcatggtgaaggcaaagcaggagcaggcgtcttacatggtgggagcaggagcaagaggcagcgagagtgggtaggggaaggtgctacacacttttaaatgcccagatctccatgaaaactctcactagaacagcaccaaggagatggtgctagaccattcatgaaggatccacccccatgatccaatcacctcccaccagcccctacctccaacaccggggattaacatttgacatgagatttgggcagagacatggatgcaaaccatgtcgcacaccctctgacacttacgcccacacgcccactcactcagctccaaccctctacctttactggctgggcctcggttgtatagaatggatgctagatatgggcctaggggaggtagaatttctaaaacggcccctgcagatgtccctccttaatctccagatgcagtgaataagatgagttatcactcctgtgatgatgttatggaatatggcacagttgaccttaagataggggggttattggtaggcctgatttaatcccatgagcccgtaaaaatagagagctttctgagtgtaggaggggagggcagagagattcaaagcaacagcacaatgaccactcctggttttggagatgaagggggctatgtgcagggattggagtgaggtcaataggagttgagagtgacccctggtcaaagccagcaagcagcctgggactccagccttgtgggcactagacctgaattctgccaacaaccggaatgaacttggaagtgaattccttcccagaaactccagacaagagtacagtgtggctaacatcttgattttggcctcttgataccctgagcatagagcccagccaagcccacccagacttctcacctatagaactgtgagctaataaatagctgttgttttaagccatcaagtttgtggcaatttgttctgcagcaatagaaaacaaatccagggtcatccttgggctccatatagcttttccaatttcctgagatacaagctgtggttaacttccagttcttccaagctcaaggggagtgagccctgaggagttagcctatctgtggttaaacctatcccttgtgcctacagagtctgagctcctggcccgcagatgctcatatgtgacaatctggagctcaactgaagaccaaggttgtcgccataatggatatccccaggaaggagaattctttgggcaccagtttgtgggtactagcttcctcactggggcagaagaacattcctaggacaagcctggtaggctgttggcttaggcagcctcccagcatttgggctgtagtgtttttttttttgtgtgtgtgtgtgtggtttttttttaaactttcttagctgttgctcaccttagatgtcacctgttgcttcttgttggtaggaccagacctcaggcagccttggctgaggcatttggaggtgaggttgcatggaaataaaaacagtgagctggaaggcatgtgtgagtgacacagaaaccagaatctcatgcgtcccagctgaggtcagaatgtgttggggagcccaaagtaatggctcttcctctgggtgtgggcattcaaaagatgccaaagggagaacctcatcctcaaggtgaatccgcctctgaggagtgactgacaaggtggcatccctggggcaggatgcttggctgagctccatttgatggaggacagaccagagaaagctgaggctgggggctcccagggctcaggttgagtttcccgaagcagtccagtgcatcacttagcaggaccaggggcaaggggaaggtaaattcctgaaaaggagccacctctgtcttgcaggttaaaatagccttgtcccaaagatgtgataacacagggtaggcaggtgagaaccagagggccatggcaagcactgggtgtgtaaacacgggaggagaactgtggttcttgaaaactcggcagtgaggatacctggccacaggccaagaggaagagagctgcttctgggtaagccctgaaacttatttggggatcaactgatttcttcaggcctgtaggtatcacactagtacctggagaggaggagggctctagtgggtcacagttgtcactgagtccttgctggtggctgtggttgtggtagaataaatactcaggaagctactgggcccatggcacaaggtagggcaggtggtcagttggtttctggcatttgacactgtgggatggcaccgtggggaggccgggttccactgggggcagacagaaacatgaggtaggagaagagtgctgatggcctcaccttaatgctgggtaatttttctgcagaagagacttgcagtgacataatctgatgtctgtttcatgaatgaggaaggtagagtcatcacaaatcagccttgcaaataagcatgggcttgtggcattttaaaccaaccttgggcccaagagccagtgtaatcatcttttggtgccaaggcaacaggtccagagggacctgaatttggtgccgatcaatccctctccccaaacagaggtacatatctgtgcctgctctagcagcggcagtcaggatggtacacggcgggctagaggagggagcagcagggctggaggctgggtggagcagccactgtgccatgggccgtgtgactttgtgccagccctttcccatctctgggaaagtgtctgtgagaagtaggctgatcttgcagatctccttggcacccagtaggtctgctgccagccatggggcctatgatgcctgtaagcttggatggcggtcgctagtccacggtcctgagcactgtctcgactcctttgtaaaacaaggagattggattcattgagcatccctctctcttctggctccaatgccccaaatgtctaactgtgtgaaatgcagtgtgattgtctctctgtgaccctattcctggtcctttctgagaccgttcatatgttgggactgagagtttgtgttatctgaagccagcatgctgtccacactgtggggaaagcctgcatgatttgctattgtcctcccctctagtgccctgtggttttagagcccctgccatgtggtctgccatttgtctctctgtctcctagggcatttgcctgctttaatcttctgtgggctgtgcaaacagccctgagcagtgcatggtgaccacaggtaggggtgtctggagggccgtgttctatctcaggcagacatgtgtaagaggaaggcatgaataattagaaacttcttaatggtagggccagcaccagtgattaatcatagcaaaattctcctgccacgcacacagcaaagagtctttatcactcaccccaattagcttctgatgtctcccacttttccttgtccttggctcttagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccggggtaaggcgtctgtgagagtgttgaatgtgccttgcatgcaaaggccaggggccccatgggccacagggtcgtgcctccctctggagcctggccctgtccgtggatgtctgggagaaggtgaagaggaggcacaggagacaaggagggccctagcagaggttgtggggtgtgggtgtggtgtctcggtggctgcctgttccccgtgaggagggtcccggggtgcaggctggcacactgtgtctgtgactcgtaagttccacatgttctctaagtccagaaagctggaattggtccctgtagcctgttgagaaaggtgccagcttgggcctttcagtgttgccaaatgtttagtagattcaaagccatggtactgagtggtttgtgtgaaattagttgttgctaaatcatctcttcttatatgtaggttcaatacccttaaatataggctagatcccttcaaccaggaagagagaatcttgtttagaaattgagcaaattggtttacactaagtcaattaacgcagtcactgaaaatgtgctaatttcacctgattggatgatgcattttttatgcatgtctgcttcttggagagaaatatcactgagttagtgccagggttaagtttggctccatctccctggccccaactcactacttaacgcctcagttggcttcattagtctctttttaacagtagctgtagaaaatatggtgaatctgagaaagcaatgcagcttattgctcttcctataaaatttcccctagctttcaaaaatttttttggttatgtgtaatggagaacacttgcagatggtacaaaatttaaaagatacaaaaatggtatcaattattcagccacccattctcctcctcagaggcaaccactggttttagtttcttatgtattctcacatatatggtctatgtacctacaattatttatgcatacatagtttatttacttatttttacaaaaatggtagtttacaatatacattatactgcatcttgcattttccacttaacaatacatcttaaagataatgccatatcaatatataaagaacttctttgtccttttaaaaaatatgtacatagtattcctttatgaggatatatcatagcttattttaattaagttcccatggatgggagtttaggttgggttggaaacaatgcaggccttgtctggagatcagcatcctgaccatgagtctttggtgttcacccaacctgaggcaggtgggcagggcattggaaagcaagagtcgaggtgggtcggccaccagctgaatgggaggatgtcagcctgtagcatataatagcttctttctcccagtctcctggctggcacagagtagtgcatggagcacctgaactgggcaactggtcctcagaaagctaagtgtctgtgagaggcaggctgatcttgcagatctccttggcacgcagtaggtctgctgtcagccatggggcctgtgatgcctgtaagcttggccggtggccacgggtccacaggggtcctgagcatcctctctgatgtccttagccatggcatgagccccttgtcatgctgagtccattggttccccagagaaagaatttggcttcgttgttggcagggacatatttttgtctaggatgtcggtgtctgctcacctattcctgccgctctcagaagccatccactggaagatgtaaaaggaattaacataccttatggggacatttggaggcaggaaaggagaatctaccatcgtaacaaaaagtcttgctttttgtatttagtatttactaaatactacttcttagtagtatttagtaaaagtataaaaacatgcataggaaaaatatattcagacttcttccctctgaggatggggtagggaggagagtagagttttagctgtatctgtgatgatttatttctttaaacctgtgagaaatttgaaagaattatgctaaatattattgtcagctctagaaggtaggttatattatctttggtgcctgtctgtatgtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtcttaaactcctgggctcaagtgatcctcctgccttggcctcccaaagtgctgggattatagatgtgagtcactgcgcctggcctcatgtggcatatttaaaagaacacaatcacacagtaaatgccaaattggtggtagggtggatcggggtgggagtaggaacagagggcatgttccctgggaagacatgtaggctctggtgtcaaacacacctgcatttgtatctgggctctgtcaatttcttgggattttgggaaagatatttctctaagcctcactttgtaaaatgtaatctgtaaatggaaatgcaaataatacctatctcccagggctgtcgtgaggattaaacaggagaatgcatgtgaagtacttagttcagttctggcatctagtgagtgttcaataaatggtagctacatttatgctgccgagttcagggaaggggaggtcggagagggctaggtggtttcctcatgaagccttgccatgaagaacctaggagcagtagaggcagtgatgaggacagtaggaaaccccactcctgaaagttggtggtgggggacacataagggcctggtggtctccatcaatgcctgggaccctggctgcctctgggggtagctggtggtgccaagttgccccagtctctggcttccttgaatttcaagtcctgtactttgagcatctggggccctaggtaaatctcagccctttgggcctatttccctatctgagggaagtgggtcctaccaccccagttttggcaaagacagacagaaatgactgtcaaatgtgtactttacatggacagaggacccctgggttctgggcatgagtatggggaagaggagcaacttccgaacatgcaggctgtagcttcacccgggccttgaactgcctgcatctcacagaccactgcattgcattagggcctcctgagctggcctgtggccgtgcctgatggggcattcccctctccagctctgcctgcatcagcccctctgtggctcctcacatgtgctctagggatggtctgttccttccaagcacagatggaggatgcccaggcaggtcactctgccttggcagcttcctttgatgcagatcttgaggtttgctcctgcctatgctggcagctggacagctgatcctggatggtgctggctgagctgcatggagttgaagcctccagctctactgatatttagcatcaatacactccttggccagggacagagtttatcaagagtcaggaaaactaattatgagaataataagaataatatcctataattcattatttgtagtgcattactgtttatgaagaattttcctatacacactattgcaaccctcacagcagcgtgttaaggcagggggtgttatcttcagaggagataggctcagagaggtaaaggagtttgctgaaagtctcacagcagggaaattgcatagaggagttttctacctcctgttggctaattctaaccttaacctatagtggttgggggcagatggctttatcattggcattctctgctctgggggagacaagttccctatcctttgctcctttggggagggagtggcttctttatctagcccctcacctggcctgggctcgggacagttattcccactgggcagtccaggtgcaatctgtttttttcctgggagaagacaccgctgctctttttaatattcctggaatctctgaagtgccgaggaaaatgaagcccatttcagttaaattttaaaaaattgttgaagtgctagccatgtgccagggactgttctagacactcagcagtgaacagcacaaattaaagtctctgcctgcatggagtttctattggagtggagaagacatcatatctgagataaagaagtgacatggtttgacatggtggtaagtgctgacgagacaaaaggaagcagggaagagcatatgagatgcggggccggcgcagggttggattttgggcaggaaggccagcgcaggcctccgtgtcttttgagcccatgtgtgctcacaaggtcaggggcactttgccatccctcaatcctgttttgcagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtaagctagcttctccgcggctgcctgtctttgcacaggtgctgttctgtaggaaggagatgagaaaggcctcacccctctgccctggggtcccctgtacttaaagcatcccagaaagagcgcggtttctcctttcctcagtgctttgcgggtttctgcaacagttttccttcataagctggcatagcctttgacttggtactccctgtcccctcttttgtttttgaggcaccatcttgctctgttgcccaggctggggtgcagtggtgcgatcttggttcactgcaacctctgcctcctgggttgaagtgattctcttgcctcagcgtcctgagtagctgggactacaggcacgtgccaccatggctaattttttatatttttagtagagacaggggttttgccatgttgcctaggctggtctcaaactccagagctcaggtagtgcacccaactcagcctcccaaagtgctgagattacaagtgtaagccactgtgaccggcctccctgtcccttctgcgtgcatagtgtggagcctctgcttgctggtagctacctgggtgcctctgaatggctgtcatccctctccccaggcaggacagcagccttgcagagagttaccagcccagagcataactatttggtgaggagtgatgaagacattgcttcaggccttgagttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagaggctgtcctcagccaggtgtgcaagtagtggctgtcccatctgggaggctgtgaggatcctgcctagggagagagactgagtgagatggcctttaaactcccttccgactctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcgactgaactttctggaatccaagttcagccttcatgagatgttaaacgaaatgtccgagttcaaagagttgaagagtaacccccaccgggacttctataacgtgagaaaggtgcgttaggggcgagtgttcacagctgcctcacccggtccccctcccagcccatgggatgccctgagccagtctgaggcttgtcccctgtgagaacttcagggctccttgctaagggcggccttcgtggccagaggggtatgaagcatatgtgcagaaggaagatgggtgagctgcatttgtgtcaggctgggcctcagacagcacttgaatcactctaggtggaaacatttgtccgcattgtatatctgttgggatgtgccctcttccttggaaaatagggcacagcctattaattggtcataaaagttgagcacagcctacttttaaggtaggggatgtattagagtcatcaaagaaagacacagctgttaagatctctttggtcccctccttgtgtccatgtgttctcattgttcagctcccttataagtgagaacatgcggtgtttggttttctcttcctgtgttagtttgctgaggatgatggcttccagctgggcttaatacctaggtgacgggttgataggtgcagcaaaccaccatggcacacgtttacctatgtaacaaacctgcacatcctgcacatgtatcctggaacttaaagcaaaataaataagtgaataaaataaaatttaaattccctgaaaaaaaaaaaagatctctctggagatgggagtttgtggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgaggcacagggtcagtgctaggcagggggtgtttgatggtgagcaagagtcacttcctgtcaaccaggtggctttgagggagaggccagaactgagctgacttagagtgagtaggagcttgccaggcagagggtgtggtaggggaatggaagtggtggcattccaggtagaggcacgtgatgtgcaaatgtcaggagggagggatggtatgagagagtcgagagagtcagaacagtgtgttgacataactgcaagcagtgtggtgtggttggagctcaggcattgggagcggggagcagcgggttgtggggagagtaaggctgcagagatgtggggaggtcctggatcatgcaggggctgtgggtttcccacagaaggcagggaggtgggccggggtgtggtggcgagctgggagagaagctcctgggggaagagtcgggatcaggctttgcttggaggagggatggctaaagctgggtggagtcacagtggggttgccatctccacaggagctctgtcccagctgggaacctcttggggacttcttctttttggggtcagctttgataagggagggtaggccaggggaggatgtggctcctctgggaaagcccagctccagcctccctgaccccctggctgggagcatatcagcaatgcagatggaagaccctacctggaggccctaagaccacttctgttacacgccaggggtccaacacagactcccacttggatgggatcaagagctttaagaagtgagagtttggcttcagctcatgtgccctgagaggcttacagaagtgttttggggatttccaggcagaagtgaaaggtgttttagacaccacttacgtgggcaccctggcattttcaccttcaagcaccatttgttccttctctgtgaggcttaggcgttcagacaggtggatgcctccatcactgtgtgaactcctctcagccctgcccaaagaacttcacacgcctagcacatgcccaggcccgtgttcaaagaaacgccttgcccagcccgatgcagccctgccctgagcatacgtgaatgctctgggcttacctgcttcctgctgcctggggccaaggtgtcctcactggctgtgctggcactgacactgttttcttctaaggtggggccccagtgggtgttcctgggtctaccagctgccctctggccacaacatgagaaacagtcctggcgtggggctagggtaacaaatcagagcctatccccagggttctcctgcagtcttggggttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagttttgctcttgttgcccaggctggagtgcagtggtacaatctcagctcactgcaacctcagcctcctgggttcaagtgattctcctgcctcagcctcccgagtagctgggattataggtgcctggcaccactcctggctaatttttgtatttttagtagagatggggttttgccatattgcccaggctggccccgaactctcagcctcaggtgatctgcctgccttggcctcccaaagtgctgagattacaggcgtgggtcaccacacctggccttgatagcactctcatagcctctactatggggaggagagctgctttctaaaatccagaatgggctggatgatggcctccgtatgtctaaagtggctattggtgtccctggggcagacaagggctgtggtctgaggcaggagctgcgacgtggccgtggatctgtgtgggtggtatctgtgaaggcacctgtcacactacagcaggtgaagggctgagacaccccgaggcccagccagcaggactgtgtgactgagacacttgttttctatgcagaagcaagacagaagagctgagtgtgtttgctgcttgggaattgggtagaagtaggtgacatccactgtggtttaagtgtcatattaagaatagcaaataggttttaccttctgtgccaaacctgaccaattaggggccacccctaaagcttagtgaaaagagtgctgtgttcgattattgatgcctgccatgggtatggaaatggtcaatgttggcttaggtcccaggtctggaaactctgctctttctttacatctgaggtcttaggtgaacacggggaatgcacttggatcctctggtgaactgaaaacactgacctccaatgaccttcaattattttgttcctaaaataatcacccttgagttctgaagtttggatggggtgcttcctggattgtccagttgttttcctcatttatcttgtgactcatgggggtaaggacaggctgacccccctgtggtgtgtcattggtaagccagaggacaggaccagaaagcccagaatccgctgagtcatgctgaggtcattgtaccaagctgtgtccagctgagctgagccaggctgaccttcttttgtgcatcccacgtgagcccagcctcatctctgaggagcctgggctttggggatgttttagttttctgctttgctttgtttccccagtgtccagtggtctgtctttctggtaagaatggcaagattaatggcaggaaggatgctgatgagtgagtgctgtggctaacgacatgggctggctggcataatgctcacagaggtccagtggatcaaatatctggtttggcattacttggagatgctcagccagccgtggacagcattccctgccctgaggtcagccgcctcctcaccccagcccgggctgagcgcccagtcggccgcagcagtagctccagagtgtggtctaatggctgtcagcagcctggccttgaggctgctgtcgtcctcccccggagctcccataggtcccttgtgctcagggagggggagtcagtttacccatagtgacttgaggccatccctcagcttagctggggcttcatttccttagggcttgtggttgtcctatgagtgaagcacagtgaaaaggcagactggggatgaggggttggggagatgggtaggatccaggcaatattagcagagccctcatcctaagattaatgaagagggttcagtaacagaatcaaattacatttaaagaatcccttctagcttctgtgtatggagaatgaattgaaccagagcacaagaaaaaggaacaagaccagttaggaggtcactgtgaattcaggcctgagaacatgcaggcttgaactcccgtggtggcagtgaggttggagaatattgtatggatttgacatccatttggaaggtagaactgatgagactcactgagggaagggagtagtaggaaggccaaggatgactcccagtttttcagcatgaccagctggattcaggacacaccatttcctgggattccagaatctgggagaaaatcaggtttgggctggggtcagagatggagagtccacttttggatatattaaatttgaactgcctttgggttatccagatagagatatcaagaaggcaatagtatgtacagttctggagcttttggctggtggcataaatttgggaattggtataaggaaaataattaaatgcacagaaatggaacagatcacctttggagagaatttatagtgagaggacaagagggcccaggaccaggcatcaagaaattccattattaagaggtctggtagtgaggatgagctgactaaggaggctgaaaaggagaggacagagatgcaaggggtcggtctggtatcacaggacttagcatgatatagagggcatgagaaatcccatgaggtgttttgagaccttgctgggctccttctgcaaaggtgccttctgcaaaaaactgcctttccctggaatgtggggagaagtctaagctgactgttcatttctgcttcttaggatttgctctaagatctttggccttgggccccacagcttgagtccatatgttggcttagggtcagtagagcggcttccagtagagtggcttcttcttgggacttggatgccctggagtttgggtgaggtgtaactagtcaaggaagggtgtgtttggaggcttggcctttagtgtctgttcttttcattcattcccacttggaggtttgctttgggaatgctctgagggttctgagagggatcaatgggaagagtgggatttgatgggccctcagggttatcactaaaactgtgagaacctgtcgtacctgttaatttgttcattcattcatccattggttcgactttgtactaggctctggggtaggtgctgaagacttagaggcatcaaacatggcccttgtccttgaggagctcccagtctagtgaaagcgtagacacacaaacgttagagtgatcgggacggtctgcacaacaatgggatgcctgtgccaggttttgaggttgggcaagggaaagagcattcagttgtgcttggaggaacaaggttggctcccaaatggaggaggttgtgggaaatttctaggtggatgagatggtggagagaaaggagggcattccagactgaagaaacacgtgggcaaagggatgcagtgtactgtaccttggtgtgtggtgtacccgtaagtggtttgtcacggctgcagcacagaatggggcagtggcaaggcgagagttaaggcttgaaataagccttgaatctcaggccaaggtgcttgggctttatcttgagactgatgggcccataggtcatttgttaactggggaatggcctgatccaatctgcattttaaaaagatttcctggtgctgtaaggaggtggaatgcgcagcaaggctgaaagggagggataccagttccgaagtctggaggagaaatggggggtgggatccagacactggtggggctgcccggatggcccatgaggtgctggggttctgtgcacattgagggttggatgtcttaactcttgttgctaggggaggtggcctgactcagggcctggtgggcgctgtgttccaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttaggagttttgtgcccttaggcaactcacagaagcctttatttccttgcctataaaatggtgacagccatgtgccttattaacttaaaaaaatattaaaacactaaatgatggtgtaactgctatggaaaacagtatggtagttcctaaaaaagttaagtatagaattacctatgcctcagcaattcatttctaggtatatacccaaaagaactgaaagcaggaacttgaacagatactcacataccaatgttcatagcagtattattcatagcagccaacagatagaaacagccggtgttcatcaacagatgaatgggtaaacaaaatgtggtatatccatacaacggaatatcattcagccataaaagggagtcaagtactgtacatgcaacaaccatgaatggatttttcaaaagattatactaaatcgaagccagacacaaaaggacaaatatcatatgattccactgatataaggtccctagaataggcaaattcatagaaacagaaaggagagtagaagctaccaggggctggggagaggaaggtatgggaagttagtgtttagtgggtatagagtttgtttgggatgataaaaaagttctggaaatggttagtggtgatggttgcacaacaatgtcaatgtacttaaagccactggaactgtatggttaaaaatggttgaaatggtaaacgttgtgttgtacatgctttattagaacaaaaaaaacttttgttaaacaaaacattgaatgatataatgtggagaaagtgctttacaaaatgtgagtagtgatagggaatgttctattattcagtggtgcagcctctctgctcactaagtcagccatgtcctgagccgagctgtggtaacttgcaggtggggcctctgctgttccttcacagggggccttgccaaaggatcccaagctgaccgagtgaggatccatggtcctggtgctcaggagtttctaaggtttcatgcaagaattgacatagaagatgtctttcggtgtggccatacagaaggccgcctcgtaaaggtctagagaggggaacgtgcatggtggctgcagaacgatgcgttgattggtgtggtctcccccctcagggccggcagacattccaccgctttgacaagttcaactccaaatacaaccctgtgggggccagtgagctgcgtgacctgtatttgaaaactgaaaactatctgggaggagagtactttgctcggatggtcaaggtgagtgaaccctcagtctctctgaggcctctcaggtgcctcccaacatctgccttcagagagtgggggccctgtgtgcccctggccccttcccctccctctgtgtaccatcagctcagggaagggtgaggtgcccaggtgcccagtgctgtggtctggctgcctgctccaggcagtgctgcatgtgccaactgcaggaaagaggagggaagggtatccaccttggccaagctcacagcacctggcctggctttcgtgtctctgcagcctgaacctagctgggtgcagatgagctccgtgtggagatgcttctgctgtggcctggttctgcagacccaaggccttcctcaccagagggggcctctcctaaagtggaacaagagcttacaggagcaggcagccctggggatttagatgagtgcttccagcctgggagcaaggtggctgggggagcaacaggaccctgctggtgacggagagtgagagtctcccatgtagctgggatgcactggggctgacccaagctcttcttgtgccaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttagtaagtgaggtggcccgctgtctaccctgtgccctacagaggtgacaatctgtccctcatgggctgctgagtctgcactcctgaggggtagggcctgttctggtgccagcttacgcttgtcctttccagggatttttccatagaaggagtgatgaaaaagatgtctgcatgacactagagctcttttttttttttttttttgagacagagtctcactctgtcacccaggctctgagtgcagtggcatgatcttggctcactgcaacctccacctccctgattcaagcaattctttgcctcagcctcccgagtagctgggattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggttcctgccaggtggggctggaaaggctggatctagcccccggcagcaccaagcagcagcctcaggtttttttttcggaaatgcaaacacttcaattcacctgctttacctcgcaacagaggccctcacaccatgtgtgattaagtacaagcccctaaagtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgagggctggggcacggggaaagaattgagtctgtgtgcccagaaagtgactggacaagctgagggacatcatcaaatttatgttttagacaaacatattctggctgttgtgtggagttggcccagaagagaaggtagctggaggtgggggcaggggtgagagtcaggggcctgcctggagacaggaggggagcttgacccagcggaaatagctcacactcgtgcgtgcttctgcctggcctggtcagacgccacaacgtgatctcacctaagcctcacaattaccccgttactatcaccattttgttgttaacagtaagcggaattattatgtgcttggtgcgtgttggacacggtgttgagtgctctccctggattatctcatttaatcctcaccaaagccctgtgaagctgctagcttcaattgacacacaaggaaattaaaacagatcataaagctaaaagtggcagagctggaatgcgtttccaggcaggctgactccagcgatgtaccctgaacccctattctatgttgcctcccaagtgagaatagtaaggtgcacagcagctaccagcttgcgtctctgaggtgtggcagcgcagggactctgcacaaagtgtggggcttggtgagaagcggtgggcgtacacctggcaggacctggacagagactgaaggaggcactggggggagtctaggatgcctcccaggtgcctggctttgcaggagcatggatgatgtgctgtccgaaggttgctgccagcaatggaggaagagcaggtatggggaggaggaggaagagcaggaggaggagacaacgcattttgcacccgaggctgtgggagatgcagtggtgaggccctgcttcagctggatagagctctgaagaggggctgaaattatccgcatgccaggccccagaaagttcgggtgaagtatggagctagtgagcacagagcagagctcaaggtcctccctggccccccaaacccgtctagggagtgcttagggtcatagcagggaccctgtcatttcctttgacacacagggctctgtgacacggaagattctggccaagctgccttgctcctctgggcctttgctgcccccataggaacaggagaggccagcagacctggctggggtctggggcgtgggctgggagccctccagtttgggccagttgtggattaagggggacagtctctttctcccatctgctattcagaggcccctttgcaaagcactgccgtggcctggtagcaagcctcccctgtgcgctgagagcccgtaccctccatgcatgtgttcttggttggggatgacccctgggatcagccagaaggctccagtgactcaggagcagccccccaggggtcccagccaaggtagaactgcagtggaagggtgggggtttcctgaggctactcaggcccatctcagagggcagctcccagtggggattggagagcagagctgcctcccaggagccatggcttagcccagcaaggaccctcttatctgtctgtgaggcagctggcgggtttctcctggccacacctggacatgccctagagtattctctacctaccgccccaaagagtgcagacccagagcccagaacctgttttttttgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccctcctgggttgctctgaatatgaattaactgacgtgagtaaagtgctttgagcagggcttgatgagtgatgtgtactaggacccttttccctcatcgcttgtcgctgctgctgatggcaatggccactcctccctgcaggctggcctcggcatagcagaggggcaggtggtggccatggctgctttgcccttcacctggcttggcagtttcctccactgtcaccaccaccacacaggggcttggcactctcctgtctcacctccagagtacctatggaagctccgaaggggcagaccttggtgttgtacccacttttcatccctgggaggaatatggcctcaggcaggccaaggggtccccagctgaggtgtgaacctgaggggcccagacccacaggcctctggcagctatgagctctgggaggctgaaccgaggctgagtcctggtcctgccttggcctggtgctcaggacctctcctgcccaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatgcatgtccatgtgcccacacacctcaaaacacacagcactttccagcctgctatatgaggcatgtctccacatgatcacacacatgcaaacatgcccaccataacacacatgccagtacagacatatgtcatgtacagtatgcaatgcagccacagtccacacgtgtccacacatttatatgtacacacaccagggcacactccacgtgtacctgtacatccctgagataatggaagcataggacatgctatcacacatgcacggtcacttactgccacaccaacaatgtccacacgtgcatattttcgttcagcaaatcactgcatctggcatgcgataggcattgccctgggcactggacaaataacggggaacaaaacagactaaatccatgcatgcccttacaggcagaggctcctaccaatacgcacacagacgaggcacacgtggccaggagttagctgcccagggcagcaggacactgagccattcccttccctacaagtcttgcatcccactttcccctgctgggccctggggtctctctagctcagcctaaactggtgctagttggtgggtgtggaggtttcgaatggggtcctgattgaaagaaatggcctggcagggtggaggcagtcctgggctgagcttttggagatgggggctctggttctggctttgctactgacctgttcagtggcatggaacatagacttcactctccgggccttggtttgcccatttccataacacagaggtcagactctgtggtttctcatggccttccctgctctggagttctacgaatgcgggacacaaggccaggagaggaattcaggagagtggctggagggcacagcagggtctctttctactgcgaggcccactctctgcccgtagaggtgatgcttcttggttctaaggggccccagggcctggacctctgcattttaggaggggtagtttccagggtgcactgggtcagcacagctgaccatgggtggtcattccccccggagctggccctgagctgtggctgcaggccccaggcagagccaactggggggggccttcctgattcggaaaccccttctcttacagggagcgcggcctgagcacgttcctgttccggccgcactgtggggaagccggctccatcacccacctggtgtctgccttcctcactgctgacaacatttcccacgggctgctcctcaagaaggtaaccaggtcactctcgggagcccgtcctgagtgactgccctgccctgggctcctgggaggctcaaccagtgaggccagaaggctgggccctcttctgggctgggatgtctgtccttatcttggttttatttttaattatgaaagtaatataatcaaactcatcacaattttgattttccaaaaactggagaaatggaaaaaagccagcccttatgctattacattaatagaaatagccattattagctttttagtatatctaatttccatcttttatccacagcatatttttaatgtgtttattatcataatgaacacagaatttggttcctgcctcgtcccttactgttgtatgacaagcattttttgatgctgcaacgtaatatctatgctcctttttccaaaggctgttgttggatgaagggtctgccactttgtctgtaattgactcaaccagtccacactagttgggcacagagtccatccaccttttcactggtgtacccttgagctctgtgcatacagtcttctccgtattttggatcactttccattggcacgatgtttgatcaaaatgctccctttccctgatcccggtgaggtgtaaccatgggtcacatttttgggtggggtgggtgctacagtagaaaaccactctatcctgggcaggtccacccctcccatcccttcagggatcatctcccaggagctggagtgtttatagtctcaacctggctgtttgcagtcaaagcaataaaacagctagaggggggcatcttctagactgggtccgtgcctaggagaaaggagctgaaggtgtaggctggagtgggctgcccttcctgccctgagccttgcctccagtttggagcaagaatgagcacttccaacagtgggtagaggcaccagggagggctggcatgcaatgtaggaatgagatgaacagtggggaaggggagagtgggtctgagtgtcctggcttcgaggaactcgggttgaggacttgggcagacatggttcagacccctggtttccactggtgaatgcttcttcccttcctttctcccttcccttttcccttctcccctctctggcacttgtcacatgagttcggtggttcttttgcagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggtaaggactttggggtgaggacagtagtgcttcagtaggcaccagtcctagcctgtcctcccatttcaggaacctgagcccatggcttagttctgcttttggggtggggttggtggcccagtgaaggcaggaaggaagccactgttgggggaaaattgtgccatccaggagccctttctttggggttcttgaaccctcaaaggcacaatttagtatctttgccttcctctattttctctttctttgacatttatgagctctgtgaccttggtaaagttattagatttctggatcaagttcttcttcatctgtaaaatggagataaaattttctctgtccctaccctgtaaggattcatgaagataatgaatcaaaggttctaacatagtgtctgcatatattcaaaatggttgctactttttaaatcaatgctattataatttctacactttgggtctctgggaaaataaaagaggaagctaacagtggtgtcatgcatggggactagccgcaagtatacccagcatgttttgatggtgtcgacaagaccagccattgcttaacaaaaacagaagcaccagagtcttttaggacagaggttctccaacctcttggtctctggacccctttatactcttaagaattgaagctttcaaagacctgttgtttatgtgggttatatctactgatatttaccatgttagaaatgaataagaaattttaaaatatttattatctcatttaaaaaccacatcaataaaccaatgaaatgttacataataatgattttttttctgaaaagtaacagtttcccctgcctttgttttgcatttttaagcctctttaatgtcttaatggaagtcagcaggactcttctagccacttctgcattcaatttgtttttaatcaaaatatgtaaaaatagaaatcttgcctcatgaaaatacataattggaaaagacaagacctttcaaaaggtcttaggaccctcaggggtccttgacctgtacttcgagaactattgctctaggctacagcggcagtggggtggggaagaggtcacagacggcttgtgatgaatagacacttcacatcccagaagggaagcaaaaccacagctcaaacccagatcattctgggattacaccattttaccacttatcctatgatcacttctcattttttttttgatgttccatctctgcttttagtactttactcatctatctatctatctatctatctatctatctatttatctatctatcatctatctatctattgcaaacttaagaaaatagtgtgttaaaaagaaaagctagagggcaagtgctaaatgtggcatgactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggtatggagtgtgacggtgctgcctgtgtccctcctgggaaggctgcctgctgtgtgccaggagccttccaggcactggggatctgtgatgaacatagcaggcagggcctctgagacactcaggcacagggagagaagacgcggcagcctcctgtgttttcatggctgcttcctcacccttctcagacctctacgcctccttggagaggccttccctgatcgcccattctaaaatagccacacacttgctattattctctatccccttaatcagtttttctccataccatttattcctgctgatgtttagttatgtgtttttctgtctttccctctagcatgtaagctctgtgagggcagaggtttgttcagaattatatccccgggccctagatagtccctggcacatagcaggcgctcaatatttcttgaatagatgaacagtatctagactgaataaaaatctagactatgggactcagacatctgtcattttttaaaaagcctgatgaggagctggcactgagacccatgttctgatgtacgttaggtcccccgacacctccctgggtgatgtcactggttgggaagaggttgcattaggggctgtgctcgtcggatgatgatgcagcagagttaaaggcttaagattcttttcatgcgcagtgtggtgccttggattggccctccccaggaacattgtccttgtcagctctcaggggcttcttaattagagtcttacctccttcccctttgcctttcccatccccagcagctgctgcagaccttatctttcctctctgatcaaggaaagcacagccaggaatgaagggctgtctgaggatgactgaggttgtcagggtgacatccttgaggacacagaggccagcaggaattttaagagttctgtggggataagatgtcctgaccaaagatctgcttcagggggactagtctgacttgctgtgactgatgtcaaagctgcccacatggctatagaaagtgaatcaaaagtatatagtttcatttgtatttctcttggtccacaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 941 - DNA, 46449 bp, Homo sapiens
agtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccaggtgggcctggccctcacttcagtgccttctcttccccggtgctggtgactcagggcatcctgcaattcatgcttgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttccaggttctcccagtggctgccatgggccaaacctagccagaatcctgctggcacacttgggaaacacaggagaggatgaggaatggatctgagggcaaacaggcccaggagcagcgcaagtgctatgaaagagatgaataaggatgagatggggttaggggagagaaaggccgggaaagagagagaaaaaatccttttttagactgggaagtcagggaaggcctctccaaggagatgacatcttagcggatgcttcagggtataaagaagctagctatgtggccttccagatagaagaatcagctagggcaaaggccccccagtttcttccagaaggcccatgtggttagaggtctgttaaaggaagaagtgctgtgaccagggctggaggacttgtggggcccagatcagactggccttgtgctccctgataagaagtttggattggagtctaagtgaaatgagaagccctcatcctttcacagtttatctcaccctgggctttatcagattttctgcctgcccggtaccctgcaaacatcaatagttgacatggtagacctttgagccctctccgacctagtctgtgatcacactagatactgcctcagttttaaaggcaagtcttttcctttcttggttgtgtagaagctcgcattttcttaactcgtttggaaagaagtaaaaagttgactactggtgtaaaggcaagaacagagcttcaccactcataagaccagtgctttccttccttgaaaggatggtgagcccataaaggcaggagtcactggtgccattggttaacctctgagtgccagccttgtgttggataaggtggggtggccccagccccagcagtgtgctcatccctggagggtcaagaagagtatgactgtagagaccctcattcacactccgtgggtggaacagaagggctgacttcatcaagtgaatggtctgcagggccttctgtgtgttatgaattgagcatttgagacccttaacaatgagaggaaaagaaatcctggcattttttattactaggaacaataagtttctggaaccagtttccactacagagtgacactgggcctgacatctgctgaagcgactgtgctcttctcaatgcccagactcagggcaaaatggaagctttcttactctaagtcttaatggtgctctgtggtttccagaaattcccctgcaaacttctctccaaaaactttgttctgtccttgcctaggttatggtgtcttagtttgcatctgtctgcgccatttgactagacgctccttgaggactggatccattgtggaacttagttggtgggcagtggatgtctggcagaggaagacatcctgcctccccattgccaccatggacactacatcagggtggctgcaacttcttggacctctgtgttctgccactcactgtcatgctctgtgactttggggaaattaggaaacctctctgggcctcagcctcgtcctcatctataaagtggagatgctaacagctaccttcatggggtgttgtgaggaatgagggaatccacaggtaaaaggcttcggacagtgtctggttatagtgcatcccgagtaaatataagtgatttctctgacttcctgctgctgagacagggaacaatagcagctcctgccattgaatacttactatgggctaagtactagcctgtgtaggttggattcattctttaattctcacatcgagcttatcaaatggatattcttagtattctgattttgcagattagggaacgaaggctcagagaagttgaatttactttcacaaagacacatagtgagtaaatgacagagcaagaactagagcccatatcttttgaatctagaccccacacttcaaccataaggctatcccctcttcaggtaggggtggagtcttcggttccctggtctgtagaccctggaatgacactaggtgctgctccctagaatgtaattgttgcttctaaatgaaatggagggaaactggtcaaagctcccgctctgtccatcggcttctttcctgaaaaaaagcttggtccctggactgtcagatgccccagcatcctcctctggggtctgcccatacccaattttgtcttttagtttctcttctcactagaggtgcctttatatgtaaatgttcgaaagttaacattttcatggaggacaccctctccccagctccctctttgtctgtggcacctcccatcccatctcctatttattcttactttacacagaattctataatctggctatattgtttcttatcccgtggcagatttaaagaagcaaattagaagcagggagagagacttctacaggcagggtcacagaggtgatgtgtggtgattataagcctgggctttggggtcagacctattgggttcaagtggcagccctgtcacttactactgaatggccttggtcaaagctcttgactgcctgagctggtttcctaaactgcaaaatgagaataataaaaggacataccttgtgagaattaaatgagcgaatacacaaaaaatccttagcgcagtgcttggagcaccattaatgttcctgttttgttattgttgttattagacagtcaacagtgagagaggaaacaaaataattatgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggagtttttttttttttttttttttctgtaccccagtggcgcctggagcgccagcaagacagaatcattcactcccctggaaagggggctaaagccagggagccaagtggtctggcttggcaggtcccagccccatggagcccagcaaactaagatccactggtggccaggcgcagtggctcatgcctgtaatcccagcacttagggaggccaaggcgagtggatcacctgacgtcaggagttcaagaccagcctggccaacatggtgaaacctcatctctactaaaaatacaaagattagccgggcgtggtggggggcacctgtaatcccagttacttgggaggttgaggcaggagaatcgcttgaacccaggagaaggaggttgcagtgatctgagatcgcaccattgcactgagcttgggtgacaagagcaaaactccgtctcaaagaaaaaaaaaaaagatccactggctcaaaattctcactgccagcacagcagcagtctgagatcaatctgggacactcaagcttcgtagggggagggtcgttggccattgctgaggcttgagtaggaggttttaccctcacagtgtaaacaaagccaccaggaagttcaaactaggtggaacccaccgcagctcagcaaagctgctgtggccagactgcctctctagatttcttctctctgggcagggcatctctgaaaaaaaggcagcagccccaatcagggacttatagataaaacccccatctccctgggacagagcacctgggggaaggggcagctgtgggcacagcttcagcagacataaatgtccctgcctgacagctctgaagagaccagcagtcctcccagcacagcgttcaagctctgctaagggtgagactgcctcctcaagtgggtccctaacccccgtgtatcctgactgggagacacctcccagtaggggccgacaggcatctcatacaggagagctctggctggcatcaggcaagtgcccctctgggatgaagcttccagaggaaagaacaggcagcagtctttgctgttctgcagcctccactagtgacacccagccaaacagggtctggagtggacctccagcaaactctagcagaggggtctgattgttaggaggaaatctaacaaacagaaaggaatagcacatctaatcagagaccacatccgaaaatcaccagcatcaaagaccaaagatagataaatccacgaagatggggatgtaaaccagtgcaaaaaggctgaaaattccaaaaaccagaatgcctcttctcctccaaatgatcacaactccttgccagcaagggaaaaaaactggacagagaatgagtttgaccaattgacagaagtaggcttcagaaggtgggtaataacaaacgcctctgagctaaaggaacatgttctaacccaatgcaaggaagataagaaccttgaaaaaaggatagatgaattgctaactagaaaaaccagtttagagaagaacataaatgacctgatggagcagaaaaacacagcacgagaacattgtgaagcattcacaagtatgaatagctgaatcaatcaaacggaagaaaggatatcagagattgaagaccaacttaatgaaataaaataagaagacaagataagaggaaaaaaaatgaaaaggaatgaacaaagcctccaagaaatatgggactatgtgcaaagaccaaacctacgtttgatggatgtacctgaaagtgacggggagaatcgaaacaagtggaaaacactcttcaggatattatccaggaaaacttccccaacctagcaagacaagccaacattcaaattcaggaaatacagagaacaccacaaagatattcctcgagaagagcaaccccaagacacataatcgtcagatgccccaaggttgaaatgaaggaaaaaatgttaagggcagccagagagaaaggtcaggctacccacaaagagaagcccatcagactaacagcagatctctctgcagaaaccctacaagccagaagagagtgggggccaatattcaacattcttgaagaaaagaattttcaacccagaatttcatatgcagccaaacaaagcttcataagcaaaggagaaataaaatcctttacagacaagcaaatgctgagagattttgtcaccaccaggcctgccttacaagagctcctgaaggaagcactaaacctggaagggagcaaccggtaccagccactgcaaaaacataccaaattgtaaagactatcaacacttcgaagaaactgcatcaactaatgggcaaaacaaccagctagcatcatgatgacaggatcaaattcacacgtaacaatattagccttaaatgtaaacgggctaaatgccccaattaaaacacacagactggcaaattggatgaagagtcaagacccaacagtgtgctgtattcaggagactcatctcaagtgcaaagacagacataggctcaaaataaagggatggaggaatatttaccaagcaaatggaaagaaaaaaaaaaaagcagaagttgcaagtttaacctctgataaaacagactttaaaccaacaaagatcaaaagagacaaggaagggcattacataatggtaaagggatcaatgcaacaagaagagctaactgtcctaaatatatatgcacccaacacaggagcacccagattcataaagcaagtcttagagacctacaaagagacttagactcccacacaataataatgggagactttaacaccccattgtgaatattagacagatcaacgagacaaaattaacaaggatattcaggacttgaactcagctctggaacaagctccaacccaaatcaacagaatatacattcttctcagcacctcatcacacttactttaaaattgaccacataattggaagtaaaacactcctcagcaaacgcaaaagaatggaaatcataacaaacagtctctcagaccacagtgcaatcaaattagaactcaggattaagaaactcactcaaaaccacacaactacatggaaactgaaaaatctgctcctgaatgactactgggtaaataaggaaatgaaggcagaaataaagatgttctttgaaaccagtgagaacaaagacacaacgtaccagaatctctgggacacatttaaagcagtgtgtagtgggaaatttatagcactaaatgtccacaagagaaagcaggaaagatctaaaatcaacaccctaacatcacaattaaaagagctagagaagcaagagcaaacaaattcaaaagctagcagaagacaagaaataactaagatcagagcagaaccgaaggagatagagacatgaaaaactcttcaaaaactcaatgaatccaggagctgttttttttttgaaaagatcaatgaaataaatagactgctagcaagactaacaaagagaaaaagagagaagaatcaaatagacacaataaaaaataataaacggggtatcaccactgatcccacagaaatacagactaccatcggagaatactataaacacctctatgcaaataaattagaaaatctagaagaattggataaattcctggatgcatacactctcccaagtctaaaccaggaagaagttgaatccctgaatagaccaataacaagttatgaaattgaggcagtaatgaatagcctaccaaccaaaaaaagcccagaaccagacagattcacagccaaattctaccagaggtacaaagaggagctggtaccattccttctgaaactattcccaacaatagtttggagctggtaccattccttctgaaactattccaaactcattttatgaggccagcatcatcctgatgccaaaacatggcagagacacaacagagaaaatttcaggccaatatccctgatgaacatcgatgtaaaagtcttcggccgggcgcggtggctcacgcctgtaatcccagcactttgggaggccgaggcgggcagatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtcctcaataatatactggcaaaccaaatccagcagcacatcaaaaagcttatccaccacgatcaagttggcttcatacctgggatgcaaggctggttcaacatatgcaaatcaatcagcgtaatccatcgcataaacagaaccaatgacgaaaaccacatgattatctgaatagatgcagaaaagtccttcaatataattcaacaccccttcatgctaaaaactctcaataaattaggtattgatggaacgtatctcaaaataaaaagagctatttatgaaaaacccacaggcaatatcatactgaatgggcaaaaactggaagcattccctttgaaaactggcgcaagacaagtatgccctctctcaccactcctattcaacatagtattggaagttctggcaggggcaatcaggcaagagaaagaaataaagactattcaaacaggaaaagaggaagtcaaattgtctctgtttgtggatgacatgattgtatatttagaaaaccccaccatctcagccccaaatctccttaagctgataagcaacttcagcaaagtctcaggataaaaaatcaatgtgcaaaaatcacaagcattcctgtatactaataacagacaaacagccaaatcatgagtgaactcccattcacaattgccactaggagaataaaatagctaggaatccaacttacaagggatgtgaaggacctcttcaaggagaattacaaaccactgctcaaggaaataagaaaggacaaaaacaaatggaaaaacattccatgctcatggataggaagaatcaatatcatgaaaatggccatactgcccaaagtaatttataggttcagtgctatccccatcaagctaccattgactttcttcacagaattagaaaaaaactactttaaatttcatatggaaccaaaaaagagcctgtatagccaagacaattctaagcaagaagaacaaagctggaggcatcacgctacctgacttcaaactatactacaaggctacagtaaacaaaacagcctggtactggtaccaaaacagatatatagaccaatggaacagaacagaggcctcagaaataacaccacacatctacaatcatctgatctttgacaaacctggcacaaacaagcaatggggaaaggattccctatttaataaatggtgttgggaaaactggctagccatatgcaaaaaactgaaactggactccttacaccttatacaaaaattaactcaagatggattaaagacttaaatgtaagacctaaaccataaaaaccctagaagaaaacctaggacattcaggacataggcatgggcaaagacttcatgtataaaacatcaaaagccatggcaacaaaagccaaaattgagaaatgggatctaattaaactaaagagcttctgcacagcaaaagaaactaccatcagagtgaataggcaaccttcagaacaggagaaaattttttcaatctatccatctgacaaagggctaatgtccagaatctacaaagaacttaaacaaatttacaagaaaacaaccccatcaaaaagtgggcaaaggatatgaacagacacttctcaaaagaagacatttatgcagccaacaaacatatgaaaaaatgctcatcatcactggtcattagagaaatgcaaatgaaaaccacaatgagataccatctcacgccagttagaatggcgatcattaaaaagtcaggaaacaacagatgctggagaggatgtggagaaataggaatgcttttacactgttggtgggagtgtaaattagttcaaccattgtggaagacagtgtggctattcctcaagaatctagaactagaaataccatttgacccagcaatcccattactgggtatatacccaaaggattataaatcattctataaagacacatgcacacgtatgtttattgcagcactatccacaatagcaaagacttggaacccacccaaatgtccatcaatgatagactggataaagaaaatatggcacatatacaccatggaatactatgcagccataaaaaagatgggttcatgtcctttgcagggacatggatgaagctagaaaccatcattctcagcaaactaacacaagaagagaaaaccaaacatcgcatgttctcactcataagtaggagttgaacaatgagaacacatggacacagggaggagaacatcacacactggggcctgttggggggtgaggggctaggggagggatagcattcggagaaatacctaatgtaggtgtcaggttgatgggtgcagcaaaccaccatggcatgtgtatacctatgtaacaaacctgcacattctttacatgtaccccagaacttaaagtataattaaaaaaagaaaaaaattaggatatagagggaaaaattttattagttgaaaaatttggctatctaggacagccgcttccctagaatgttttgagtgaaattgagaaacatatgtgctttatgaattgagcatagcacagctaaagtgttgctaagtcacttcattttatgaaacttgtgaaaataagaatggggaactttttaaacattcaggatcattgacaaaggagcttcatttgaaatagtcaatctatccccttttaaagttagggagagattgggctgggcgcggtggctcacacctgtaatcccagcactttgggaggctgaggcgggtggatcacctgaagtcaggagttggagaccagcctggccaacatgtagaaaccctgtctttactaaaaatataaaggttagctgggtgtggtggcacatgtctgtaatcccagcaactccggaggctgaggcaggagaattgcttgaacctgagagtcaaaggtttcagaaagccaagatcaccccactgctctccagcctggctgagggagggagactctgtcttgaaaaagaaaaagttagggagattgggaagccgaggtgggtggatcacttgaggccaggagtttgagaccagcctggccaacatggcaaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggagatgagtggagattacagtaggccaggaggggttgtggggaagggaggatggagaaagaaggggcaggtttccagaggagctcagggagagacagagggtggggctgtgagttttcacacctgattggctgcaaagtgttagaatcaaagttacacccacctggccaggatgctggtcatctggctgcatatgcggagtgagtgatctctgtgcgcccctgctctctctgtagggacccctgttatagtgcccatcgtgcagcatatttctccagataggctgggacctctggtctcaagtacagggaaggtgtcagcccctcttagttccctccttagatgggggtcccaattccaggtgagccaatgcaggggcagcgtgagcagcagcagtgtgagcctatggaagtggaggatgcctgtcccgcctgatggcattcagattcccagtgtttgcaaaactctgtgctggtttgtgacttctgattccaacctttattttagcgtaacaattctcatgtggaggggctgccagaatgagctgagtgtgcgtgggggaggagttcaaaccagcctccatgttctgaaatgtcccccctctgaccccattgctccactgctcccacccctagtctggattaagtgtctcctctggggtcccaaaatatccagggcatctcattacaccaaccacactgtatgataatctgtggaactgtctgggttcatctcagccatcacagtcggcccctggaggcgggagttatatcttatctactcctctacacccagggcctggcacacagtagtttattgaatgaagtggggtccacgtgtggcccccagctcatagtacacatatgagagcctggtgaaaggttggctccagtgcccctccctgcctagtagtcatctggacagaccacacagggcagtgggcttcagatggcccctggtaagatgctggctattctctaggagagcaaggtgggcctgaagggctcctcactttagcatttgagtgctatatagggaaggccctgggagcctgattccccagagcggaggagggctggggagtggagcagagtaagggaggggacttagtgactgtcaggggcaaccaagggccatagagcaggtggagcaccagacaggtgctgggaggtaagatgctgtaacaacagcccaggtgacctgatcaactctttgtcttgtgggcctggttagcaagaatgtccttgtgcgtcaagaggataaatctatttcagggatgacaaaactgctcctggccctttgagccctcaggcttggcctggagctggtgtcctcacagccccacactctgctggctccttggcaggagtgtgcttctgccaggtgcaagtgtgggtgggggaaggagggggtgtgccagctgtagcccagcaaatgctggcgccccaggggctagtgcaaggtgcagcaggtgagatagtggacagacagaccttggcccatcagaaggaagtgctttctaacaggggcaccagatcagttttgttcatacacacactcatagacacactcactcactgtattagtttgcactgctataaagaaatacctgagactggtaatttataaaataatgaggtataattggctcatagttctgcaggctgtacaggaagcatggcagcatctgcttctgaggaagcctcagggaactttgactcatggtgaaggcaaagcaggagcaggcgtcttacatggtgggagcaggagcaagaggcagcgagagtgggtaggggaaggtgctacacacttttaaatgcccagatctccatgaaaactctcactagaacagcaccaaggagatggtgctagaccattcatgaaggatccacccccatgatccaatcacctcccaccagcccctacctccaacaccggggattaacatttgacatgagatttgggcagagacatggatgcaaaccatgtcgcacaccctctgacacttacgcccacacgcccactcactcagctccaaccctctacctttactggctgggcctcggttgtatagaatggatgctagatatgggcctaggggaggtagaatttctaaaacggcccctgcagatgtccctccttaatctccagatgcagtgaataagatgagttatcactcctgtgatgatgttatggaatatggcacagttgaccttaagataggggggttattggtaggcctgatttaatcccatgagcccgtaaaaatagagagctttctgagtgtaggaggggagggcagagagattcaaagcaacagcacaatgaccactcctggttttggagatgaagggggctatgtgcagggattggagtgaggtcaataggagttgagagtgacccctggtcaaagccagcaagcagcctgggactccagccttgtgggcactagacctgaattctgccaacaaccggaatgaacttggaagtgaattccttcccagaaactccagacaagagtacagtgtggctaacatcttgattttggcctcttgataccctgagcatagagcccagccaagcccacccagacttctcacctatagaactgtgagctaataaatagctgttgttttaagccatcaagtttgtggcaatttgttctgcagcaatagaaaacaaatccagggtcatccttgggctccatatagcttttccaatttcctgagatacaagctgtggttaacttccagttcttccaagctcaaggggagtgagccctgaggagttagcctatctgtggttaaacctatcccttgtgcctacagagtctgagctcctggcccgcagatgctcatatgtgacaatctggagctcaactgaagaccaaggttgtcgccataatggatatccccaggaaggagaattctttgggcaccagtttgtgggtactagcttcctcactggggcagaagaacattcctaggacaagcctggtaggctgttggcttaggcagcctcccagcatttgggctgtagtgtttttttttttgtgtgtgtgtgtgtggtttttttttaaactttcttagctgttgctcaccttagatgtcacctgttgcttcttgttggtaggaccagacctcaggcagccttggctgaggcatttggaggtgaggttgcatggaaataaaaacagtgagctggaaggcatgtgtgagtgacacagaaaccagaatctcatgcgtcccagctgaggtcagaatgtgttggggagcccaaagtaatggctcttcctctgggtgtgggcattcaaaagatgccaaagggagaacctcatcctcaaggtgaatccgcctctgaggagtgactgacaaggtggcatccctggggcaggatgcttggctgagctccatttgatggaggacagaccagagaaagctgaggctgggggctcccagggctcaggttgagtttcccgaagcagtccagtgcatcacttagcaggaccaggggcaaggggaaggtaaattcctgaaaaggagccacctctgtcttgcaggttaaaatagccttgtcccaaagatgtgataacacagggtaggcaggtgagaaccagagggccatggcaagcactgggtgtgtaaacacgggaggagaactgtggttcttgaaaactcggcagtgaggatacctggccacaggccaagaggaagagagctgcttctgggtaagccctgaaacttatttggggatcaactgatttcttcaggcctgtaggtatcacactagtacctggagaggaggagggctctagtgggtcacagttgtcactgagtccttgctggtggctgtggttgtggtagaataaatactcaggaagctactgggcccatggcacaaggtagggcaggtggtcagttggtttctggcatttgacactgtgggatggcaccgtggggaggccgggttccactgggggcagacagaaacatgaggtaggagaagagtgctgatggcctcaccttaatgctgggtaatttttctgcagaagagacttgcagtgacataatctgatgtctgtttcatgaatgaggaaggtagagtcatcacaaatcagccttgcaaataagcatgggcttgtggcattttaaaccaaccttgggcccaagagccagtgtaatcatcttttggtgccaaggcaacaggtccagagggacctgaatttggtgccgatcaatccctctccccaaacagaggtacatatctgtgcctgctctagcagcggcagtcaggatggtacacggcgggctagaggagggagcagcagggctggaggctgggtggagcagccactgtgccatgggccgtgtgactttgtgccagccctttcccatctctgggaaagtgtctgtgagaagtaggctgatcttgcagatctccttggcacccagtaggtctgctgccagccatggggcctatgatgcctgtaagcttggatggcggtcgctagtccacggtcctgagcactgtctcgactcctttgtaaaacaaggagattggattcattgagcatccctctctcttctggctccaatgccccaaatgtctaactgtgtgaaatgcagtgtgattgtctctctgtgaccctattcctggtcctttctgagaccgttcatatgttgggactgagagtttgtgttatctgaagccagcatgctgtccacactgtggggaaagcctgcatgatttgctattgtcctcccctctagtgccctgtggttttagagcccctgccatgtggtctgccatttgtctctctgtctcctagggcatttgcctgctttaatcttctgtgggctgtgcaaacagccctgagcagtgcatggtgaccacaggtaggggtgtctggagggccgtgttctatctcaggcagacatgtgtaagaggaaggcatgaataattagaaacttcttaatggtagggccagcaccagtgattaatcatagcaaaattctcctgccacgcacacagcaaagagtctttatcactcaccccaattagcttctgatgtctcccacttttccttgtccttggctcttagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccggggtaaggcgtctgtgagagtgttgaatgtgccttgcatgcaaaggccaggggccccatgggccacagggtcgtgcctccctctggagcctggccctgtccgtggatgtctgggagaaggtgaagaggaggcacaggagacaaggagggccctagcagaggttgtggggtgtgggtgtggtgtctcggtggctgcctgttccccgtgaggagggtcccggggtgcaggctggcacactgtgtctgtgactcgtaagttccacatgttctctaagtccagaaagctggaattggtccctgtagcctgttgagaaaggtgccagcttgggcctttcagtgttgccaaatgtttagtagattcaaagccatggtactgagtggtttgtgtgaaattagttgttgctaaatcatctcttcttatatgtaggttcaatacccttaaatataggctagatcccttcaaccaggaagagagaatcttgtttagaaattgagcaaattggtttacactaagtcaattaacgcagtcactgaaaatgtgctaatttcacctgattggatgatgcattttttatgcatgtctgcttcttggagagaaatatcactgagttagtgccagggttaagtttggctccatctccctggccccaactcactacttaacgcctcagttggcttcattagtctctttttaacagtagctgtagaaaatatggtgaatctgagaaagcaatgcagcttattgctcttcctataaaatttcccctagctttcaaaaatttttttggttatgtgtaatggagaacacttgcagatggtacaaaatttaaaagatacaaaaatggtatcaattattcagccacccattctcctcctcagaggcaaccactggttttagtttcttatgtattctcacatatatggtctatgtacctacaattatttatgcatacatagtttatttacttatttttacaaaaatggtagtttacaatatacattatactgcatcttgcattttccacttaacaatacatcttaaagataatgccatatcaatatataaagaacttctttgtccttttaaaaaatatgtacatagtattcctttatgaggatatatcatagcttattttaattaagttcccatggatgggagtttaggttgggttggaaacaatgcaggccttgtctggagatcagcatcctgaccatgagtctttggtgttcacccaacctgaggcaggtgggcagggcattggaaagcaagagtcgaggtgggtcggccaccagctgaatgggaggatgtcagcctgtagcatataatagcttctttctcccagtctcctggctggcacagagtagtgcatggagcacctgaactgggcaactggtcctcagaaagctaagtgtctgtgagaggcaggctgatcttgcagatctccttggcacgcagtaggtctgctgtcagccatggggcctgtgatgcctgtaagcttggccggtggccacgggtccacaggggtcctgagcatcctctctgatgtccttagccatggcatgagccccttgtcatgctgagtccattggttccccagagaaagaatttggcttcgttgttggcagggacatatttttgtctaggatgtcggtgtctgctcacctattcctgccgctctcagaagccatccactggaagatgtaaaaggaattaacataccttatggggacatttggaggcaggaaaggagaatctaccatcgtaacaaaaagtcttgctttttgtatttagtatttactaaatactacttcttagtagtatttagtaaaagtataaaaacatgcataggaaaaatatattcagacttcttccctctgaggatggggtagggaggagagtagagttttagctgtatctgtgatgatttatttctttaaacctgtgagaaatttgaaagaattatgctaaatattattgtcagctctagaaggtaggttatattatctttggtgcctgtctgtatgtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtcttaaactcctgggctcaagtgatcctcctgccttggcctcccaaagtgctgggattatagatgtgagtcactgcgcctggcctcatgtggcatatttaaaagaacacaatcacacagtaaatgccaaattggtggtagggtggatcggggtgggagtaggaacagagggcatgttccctgggaagacatgtaggctctggtgtcaaacacacctgcatttgtatctgggctctgtcaatttcttgggattttgggaaagatatttctctaagcctcactttgtaaaatgtaatctgtaaatggaaatgcaaataatacctatctcccagggctgtcgtgaggattaaacaggagaatgcatgtgaagtacttagttcagttctggcatctagtgagtgttcaataaatggtagctacatttatgctgccgagttcagggaaggggaggtcggagagggctaggtggtttcctcatgaagccttgccatgaagaacctaggagcagtagaggcagtgatgaggacagtaggaaaccccactcctgaaagttggtggtgggggacacataagggcctggtggtctccatcaatgcctgggaccctggctgcctctgggggtagctggtggtgccaagttgccccagtctctggcttccttgaatttcaagtcctgtactttgagcatctggggccctaggtaaatctcagccctttgggcctatttccctatctgagggaagtgggtcctaccaccccagttttggcaaagacagacagaaatgactgtcaaatgtgtactttacatggacagaggacccctgggttctgggcatgagtatggggaagaggagcaacttccgaacatgcaggctgtagcttcacccgggccttgaactgcctgcatctcacagaccactgcattgcattagggcctcctgagctggcctgtggccgtgcctgatggggcattcccctctccagctctgcctgcatcagcccctctgtggctcctcacatgtgctctagggatggtctgttccttccaagcacagatggaggatgcccaggcaggtcactctgccttggcagcttcctttgatgcagatcttgaggtttgctcctgcctatgctggcagctggacagctgatcctggatggtgctggctgagctgcatggagttgaagcctccagctctactgatatttagcatcaatacactccttggccagggacagagtttatcaagagtcaggaaaactaattatgagaataataagaataatatcctataattcattatttgtagtgcattactgtttatgaagaattttcctatacacactattgcaaccctcacagcagcgtgttaaggcagggggtgttatcttcagaggagataggctcagagaggtaaaggagtttgctgaaagtctcacagcagggaaattgcatagaggagttttctacctcctgttggctaattctaaccttaacctatagtggttgggggcagatggctttatcattggcattctctgctctgggggagacaagttccctatcctttgctcctttggggagggagtggcttctttatctagcccctcacctggcctgggctcgggacagttattcccactgggcagtccaggtgcaatctgtttttttcctgggagaagacaccgctgctctttttaatattcctggaatctctgaagtgccgaggaaaatgaagcccatttcagttaaattttaaaaaattgttgaagtgctagccatgtgccagggactgttctagacactcagcagtgaacagcacaaattaaagtctctgcctgcatggagtttctattggagtggagaagacatcatatctgagataaagaagtgacatggtttgacatggtggtaagtgctgacgagacaaaaggaagcagggaagagcatatgagatgcggggccggcgcagggttggattttgggcaggaaggccagcgcaggcctccgtgtcttttgagcccatgtgtgctcacaaggtcaggggcactttgccatccctcaatcctgttttgcagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtaagctagcttctccgcggctgcctgtctttgcacaggtgctgttctgtaggaaggagatgagaaaggcctcacccctctgccctggggtcccctgtacttaaagcatcccagaaagagcgcggtttctcctttcctcagtgctttgcgggtttctgcaacagttttccttcataagctggcatagcctttgacttggtactccctgtcccctcttttgtttttgaggcaccatcttgctctgttgcccaggctggggtgcagtggtgcgatcttggttcactgcaacctctgcctcctgggttgaagtgattctcttgcctcagcgtcctgagtagctgggactacaggcacgtgccaccatggctaattttttatatttttagtagagacaggggttttgccatgttgcctaggctggtctcaaactccagagctcaggtagtgcacccaactcagcctcccaaagtgctgagattacaagtgtaagccactgtgaccggcctccctgtcccttctgcgtgcatagtgtggagcctctgcttgctggtagctacctgggtgcctctgaatggctgtcatccctctccccaggcaggacagcagccttgcagagagttaccagcccagagcataactatttggtgaggagtgatgaagacattgcttcaggccttgagttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagaggctgtcctcagccaggtgtgcaagtagtggctgtcccatctgggaggctgtgaggatcctgcctagggagagagactgagtgagatggcctttaaactcccttccgactctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcgactgaactttctggaatccaagttcagccttcatgagatgttaaacgaaatgtccgagttcaaagagttgaagagtaacccccaccgggacttctataacgtgagaaaggtgcgttaggggcgagtgttcacagctgcctcacccggtccccctcccagcccatgggatgccctgagccagtctgaggcttgtcccctgtgagaacttcagggctccttgctaagggcggccttcgtggccagaggggtatgaagcatatgtgcagaaggaagatgggtgagctgcatttgtgtcaggctgggcctcagacagcacttgaatcactctaggtggaaacatttgtccgcattgtatatctgttgggatgtgccctcttccttggaaaatagggcacagcctattaattggtcataaaagttgagcacagcctacttttaaggtaggggatgtattagagtcatcaaagaaagacacagctgttaagatctctttggtcccctccttgtgtccatgtgttctcattgttcagctcccttataagtgagaacatgcggtgtttggttttctcttcctgtgttagtttgctgaggatgatggcttccagctgggcttaatacctaggtgacgggttgataggtgcagcaaaccaccatggcacacgtttacctatgtaacaaacctgcacatcctgcacatgtatcctggaacttaaagcaaaataaataagtgaataaaataaaatttaaattccctgaaaaaaaaaaaagatctctctggagatgggagtttgtggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgaggcacagggtcagtgctaggcagggggtgtttgatggtgagcaagagtcacttcctgtcaaccaggtggctttgagggagaggccagaactgagctgacttagagtgagtaggagcttgccaggcagagggtgtggtaggggaatggaagtggtggcattccaggtagaggcacgtgatgtgcaaatgtcaggagggagggatggtatgagagagtcgagagagtcagaacagtgtgttgacataactgcaagcagtgtggtgtggttggagctcaggcattgggagcggggagcagcgggttgtggggagagtaaggctgcagagatgtggggaggtcctggatcatgcaggggctgtgggtttcccacagaaggcagggaggtgggccggggtgtggtggcgagctgggagagaagctcctgggggaagagtcgggatcaggctttgcttggaggagggatggctaaagctgggtggagtcacagtggggttgccatctccacaggagctctgtcccagctgggaacctcttggggacttcttctttttggggtcagctttgataagggagggtaggccaggggaggatgtggctcctctgggaaagcccagctccagcctccctgaccccctggctgggagcatatcagcaatgcagatggaagaccctacctggaggccctaagaccacttctgttacacgccaggggtccaacacagactcccacttggatgggatcaagagctttaagaagtgagagtttggcttcagctcatgtgccctgagaggcttacagaagtgttttggggatttccaggcagaagtgaaaggtgttttagacaccacttacgtgggcaccctggcattttcaccttcaagcaccatttgttccttctctgtgaggcttaggcgttcagacaggtggatgcctccatcactgtgtgaactcctctcagccctgcccaaagaacttcacacgcctagcacatgcccaggcccgtgttcaaagaaacgccttgcccagcccgatgcagccctgccctgagcatacgtgaatgctctgggcttacctgcttcctgctgcctggggccaaggtgtcctcactggctgtgctggcactgacactgttttcttctaaggtggggccccagtgggtgttcctgggtctaccagctgccctctggccacaacatgagaaacagtcctggcgtggggctagggtaacaaatcagagcctatccccagggttctcctgcagtcttggggttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagttttgctcttgttgcccaggctggagtgcagtggtacaatctcagctcactgcaacctcagcctcctgggttcaagtgattctcctgcctcagcctcccgagtagctgggattataggtgcctggcaccactcctggctaatttttgtatttttagtagagatggggttttgccatattgcccaggctggccccgaactctcagcctcaggtgatctgcctgccttggcctcccaaagtgctgagattacaggcgtgggtcaccacacctggccttgatagcactctcatagcctctactatggggaggagagctgctttctaaaatccagaatgggctggatgatggcctccgtatgtctaaagtggctattggtgtccctggggcagacaagggctgtggtctgaggcaggagctgcgacgtggccgtggatctgtgtgggtggtatctgtgaaggcacctgtcacactacagcaggtgaagggctgagacaccccgaggcccagccagcaggactgtgtgactgagacacttgttttctatgcagaagcaagacagaagagctgagtgtgtttgctgcttgggaattgggtagaagtaggtgacatccactgtggtttaagtgtcatattaagaatagcaaataggttttaccttctgtgccaaacctgaccaattaggggccacccctaaagcttagtgaaaagagtgctgtgttcgattattgatgcctgccatgggtatggaaatggtcaatgttggcttaggtcccaggtctggaaactctgctctttctttacatctgaggtcttaggtgaacacggggaatgcacttggatcctctggtgaactgaaaacactgacctccaatgaccttcaattattttgttcctaaaataatcacccttgagttctgaagtttggatggggtgcttcctggattgtccagttgttttcctcatttatcttgtgactcatgggggtaaggacaggctgacccccctgtggtgtgtcattggtaagccagaggacaggaccagaaagcccagaatccgctgagtcatgctgaggtcattgtaccaagctgtgtccagctgagctgagccaggctgaccttcttttgtgcatcccacgtgagcccagcctcatctctgaggagcctgggctttggggatgttttagttttctgctttgctttgtttccccagtgtccagtggtctgtctttctggtaagaatggcaagattaatggcaggaaggatgctgatgagtgagtgctgtggctaacgacatgggctggctggcataatgctcacagaggtccagtggatcaaatatctggtttggcattacttggagatgctcagccagccgtggacagcattccctgccctgaggtcagccgcctcctcaccccagcccgggctgagcgcccagtcggccgcagcagtagctccagagtgtggtctaatggctgtcagcagcctggccttgaggctgctgtcgtcctcccccggagctcccataggtcccttgtgctcagggagggggagtcagtttacccatagtgacttgaggccatccctcagcttagctggggcttcatttccttagggcttgtggttgtcctatgagtgaagcacagtgaaaaggcagactggggatgaggggttggggagatgggtaggatccaggcaatattagcagagccctcatcctaagattaatgaagagggttcagtaacagaatcaaattacatttaaagaatcccttctagcttctgtgtatggagaatgaattgaaccagagcacaagaaaaaggaacaagaccagttaggaggtcactgtgaattcaggcctgagaacatgcaggcttgaactcccgtggtggcagtgaggttggagaatattgtatggatttgacatccatttggaaggtagaactgatgagactcactgagggaagggagtagtaggaaggccaaggatgactcccagtttttcagcatgaccagctggattcaggacacaccatttcctgggattccagaatctgggagaaaatcaggtttgggctggggtcagagatggagagtccacttttggatatattaaatttgaactgcctttgggttatccagatagagatatcaagaaggcaatagtatgtacagttctggagcttttggctggtggcataaatttgggaattggtataaggaaaataattaaatgcacagaaatggaacagatcacctttggagagaatttatagtgagaggacaagagggcccaggaccaggcatcaagaaattccattattaagaggtctggtagtgaggatgagctgactaaggaggctgaaaaggagaggacagagatgcaaggggtcggtctggtatcacaggacttagcatgatatagagggcatgagaaatcccatgaggtgttttgagaccttgctgggctccttctgcaaaggtgccttctgcaaaaaactgcctttccctggaatgtggggagaagtctaagctgactgttcatttctgcttcttaggatttgctctaagatctttggccttgggccccacagcttgagtccatatgttggcttagggtcagtagagcggcttccagtagagtggcttcttcttgggacttggatgccctggagtttgggtgaggtgtaactagtcaaggaagggtgtgtttggaggcttggcctttagtgtctgttcttttcattcattcccacttggaggtttgctttgggaatgctctgagggttctgagagggatcaatgggaagagtgggatttgatgggccctcagggttatcactaaaactgtgagaacctgtcgtacctgttaatttgttcattcattcatccattggttcgactttgtactaggctctggggtaggtgctgaagacttagaggcatcaaacatggcccttgtccttgaggagctcccagtctagtgaaagcgtagacacacaaacgttagagtgatcgggacggtctgcacaacaatgggatgcctgtgccaggttttgaggttgggcaagggaaagagcattcagttgtgcttggaggaacaaggttggctcccaaatggaggaggttgtgggaaatttctaggtggatgagatggtggagagaaaggagggcattccagactgaagaaacacgtgggcaaagggatgcagtgtactgtaccttggtgtgtggtgtacccgtaagtggtttgtcacggctgcagcacagaatggggcagtggcaaggcgagagttaaggcttgaaataagccttgaatctcaggccaaggtgcttgggctttatcttgagactgatgggcccataggtcatttgttaactggggaatggcctgatccaatctgcattttaaaaagatttcctggtgctgtaaggaggtggaatgcgcagcaaggctgaaagggagggataccagttccgaagtctggaggagaaatggggggtgggatccagacactggtggggctgcccggatggcccatgaggtgctggggttctgtgcacattgagggttggatgtcttaactcttgttgctaggggaggtggcctgactcagggcctggtgggcgctgtgttccaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttaggagttttgtgcccttaggcaactcacagaagcctttatttccttgcctataaaatggtgacagccatgtgccttattaacttaaaaaaatattaaaacactaaatgatggtgtaactgctatggaaaacagtatggtagttcctaaaaaagttaagtatagaattacctatgcctcagcaattcatttctaggtatatacccaaaagaactgaaagcaggaacttgaacagatactcacataccaatgttcatagcagtattattcatagcagccaacagatagaaacagccggtgttcatcaacagatgaatgggtaaacaaaatgtggtatatccatacaacggaatatcattcagccataaaagggagtcaagtactgtacatgcaacaaccatgaatggatttttcaaaagattatactaaatcgaagccagacacaaaaggacaaatatcatatgattccactgatataaggtccctagaataggcaaattcatagaaacagaaaggagagtagaagctaccaggggctggggagaggaaggtatgggaagttagtgtttagtgggtatagagtttgtttgggatgataaaaaagttctggaaatggttagtggtgatggttgcacaacaatgtcaatgtacttaaagccactggaactgtatggttaaaaatggttgaaatggtaaacgttgtgttgtacatgctttattagaacaaaaaaaacttttgttaaacaaaacattgaatgatataatgtggagaaagtgctttacaaaatgtgagtagtgatagggaatgttctattattcagtggtgcagcctctctgctcactaagtcagccatgtcctgagccgagctgtggtaacttgcaggtggggcctctgctgttccttcacagggggccttgccaaaggatcccaagctgaccgagtgaggatccatggtcctggtgctcaggagtttctaaggtttcatgcaagaattgacatagaagatgtctttcggtgtggccatacagaaggccgcctcgtaaaggtctagagaggggaacgtgcatggtggctgcagaacgatgcgttgattggtgtggtctcccccctcagggccggcagacattccaccgctttgacaagttcaactccaaatacaaccctgtgggggccagtgagctgcgtgacctgtatttgaaaactgaaaactatctgggaggagagtactttgctcggatggtcaaggtgagtgaaccctcagtctctctgaggcctctcaggtgcctcccaacatctgccttcagagagtgggggccctgtgtgcccctggccccttcccctccctctgtgtaccatcagctcagggaagggtgaggtgcccaggtgcccagtgctgtggtctggctgcctgctccaggcagtgctgcatgtgccaactgcaggaaagaggagggaagggtatccaccttggccaagctcacagcacctggcctggctttcgtgtctctgcagcctgaacctagctgggtgcagatgagctccgtgtggagatgcttctgctgtggcctggttctgcagacccaaggccttcctcaccagagggggcctctcctaaagtggaacaagagcttacaggagcaggcagccctggggatttagatgagtgcttccagcctgggagcaaggtggctgggggagcaacaggaccctgctggtgacggagagtgagagtctcccatgtagctgggatgcactggggctgacccaagctcttcttgtgccaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttagtaagtgaggtggcccgctgtctaccctgtgccctacagaggtgacaatctgtccctcatgggctgctgagtctgcactcctgaggggtagggcctgttctggtgccagcttacgcttgtcctttccagggatttttccatagaaggagtgatgaaaaagatgtctgcatgacactagagctcttttttttttttttttttgagacagagtctcactctgtcacccaggctctgagtgcagtggcatgatcttggctcactgcaacctccacctccctgattcaagcaattctttgcctcagcctcccgagtagctgggattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggttcctgccaggtggggctggaaaggctggatctagcccccggcagcaccaagcagcagcctcaggtttttttttcggaaatgcaaacacttcaattcacctgctttacctcgcaacagaggccctcacaccatgtgtgattaagtacaagcccctaaagtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgagggctggggcacggggaaagaattgagtctgtgtgcccagaaagtgactggacaagctgagggacatcatcaaatttatgttttagacaaacatattctggctgttgtgtggagttggcccagaagagaaggtagctggaggtgggggcaggggtgagagtcaggggcctgcctggagacaggaggggagcttgacccagcggaaatagctcacactcgtgcgtgcttctgcctggcctggtcagacgccacaacgtgatctcacctaagcctcacaattaccccgttactatcaccattttgttgttaacagtaagcggaattattatgtgcttggtgcgtgttggacacggtgttgagtgctctccctggattatctcatttaatcctcaccaaagccctgtgaagctgctagcttcaattgacacacaaggaaattaaaacagatcataaagctaaaagtggcagagctggaatgcgtttccaggcaggctgactccagcgatgtaccctgaacccctattctatgttgcctcccaagtgagaatagtaaggtgcacagcagctaccagcttgcgtctctgaggtgtggcagcgcagggactctgcacaaagtgtggggcttggtgagaagcggtgggcgtacacctggcaggacctggacagagactgaaggaggcactggggggagtctaggatgcctcccaggtgcctggctttgcaggagcatggatgatgtgctgtccgaaggttgctgccagcaatggaggaagagcaggtatggggaggaggaggaagagcaggaggaggagacaacgcattttgcacccgaggctgtgggagatgcagtggtgaggccctgcttcagctggatagagctctgaagaggggctgaaattatccgcatgccaggccccagaaagttcgggtgaagtatggagctagtgagcacagagcagagctcaaggtcctccctggccccccaaacccgtctagggagtgcttagggtcatagcagggaccctgtcatttcctttgacacacagggctctgtgacacggaagattctggccaagctgccttgctcctctgggcctttgctgcccccataggaacaggagaggccagcagacctggctggggtctggggcgtgggctgggagccctccagtttgggccagttgtggattaagggggacagtctctttctcccatctgctattcagaggcccctttgcaaagcactgccgtggcctggtagcaagcctcccctgtgcgctgagagcccgtaccctccatgcatgtgttcttggttggggatgacccctgggatcagccagaaggctccagtgactcaggagcagccccccaggggtcccagccaaggtagaactgcagtggaagggtgggggtttcctgaggctactcaggcccatctcagagggcagctcccagtggggattggagagcagagctgcctcccaggagccatggcttagcccagcaaggaccctcttatctgtctgtgaggcagctggcgggtttctcctggccacacctggacatgccctagagtattctctacctaccgccccaaagagtgcagacccagagcccagaacctgttttttttgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccctcctgggttgctctgaatatgaattaactgacgtgagtaaagtgctttgagcagggcttgatgagtgatgtgtactaggacccttttccctcatcgcttgtcgctgctgctgatggcaatggccactcctccctgcaggctggcctcggcatagcagaggggcaggtggtggccatggctgctttgcccttcacctggcttggcagtttcctccactgtcaccaccaccacacaggggcttggcactctcctgtctcacctccagagtacctatggaagctccgaaggggcagaccttggtgttgtacccacttttcatccctgggaggaatatggcctcaggcaggccaaggggtccccagctgaggtgtgaacctgaggggcccagacccacaggcctctggcagctatgagctctgggaggctgaaccgaggctgagtcctggtcctgccttggcctggtgctcaggacctctcctgcccaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatgcatgtccatgtgcccacacacctcaaaacacacagcactttccagcctgctatatgaggcatgtctccacatgatcacacacatgcaaacatgcccaccataacacacatgccagtacagacatatgtcatgtacagtatgcaatgcagccacagtccacacgtgtccacacatttatatgtacacacaccagggcacactccacgtgtacctgtacatccctgagataatggaagcataggacatgctatcacacatgcacggtcacttactgccacaccaacaatgtccacacgtgcatattttcgttcagcaaatcactgcatctggcatgcgataggcattgccctgggcactggacaaataacggggaacaaaacagactaaatccatgcatgcccttacaggcagaggctcctaccaatacgcacacagacgaggcacacgtggccaggagttagctgcccagggcagcaggacactgagccattcccttccctacaagtcttgcatcccactttcccctgctgggccctggggtctctctagctcagcctaaactggtgctagttggtgggtgtggaggtttcgaatggggtcctgattgaaagaaatggcctggcagggtggaggcagtcctgggctgagcttttggagatgggggctctggttctggctttgctactgacctgttcagtggcatggaacatagacttcactctccgggccttggtttgcccatttccataacacagaggtcagactctgtggtttctcatggccttccctgctctggagttctacgaatgcgggacacaaggccaggagaggaattcaggagagtggctggagggcacagcagggtctctttctactgcgaggcccactctctgcccgtagaggtgatgcttcttggttctaaggggccccagggcctggacctctgcattttaggaggggtagtttccagggtgcactgggtcagcacagctgaccatgggtggtcattccccccggagctggccctgagctgtggctgcaggccccaggcagagccaactggggggggccttcctgattcggaaaccccttctcttacagggagcgcggcctgagcacgttcctgttccggccgcactgtggggaagccggctccatcacccacctggtgtctgccttcctcactgctgacaacatttcccacgggctgctcctcaagaaggtaaccaggtcactctcgggagcccgtcctgagtgactgccctgccctgggctcctgggaggctcaaccagtgaggccagaaggctgggccctcttctgggctgggatgtctgtccttatcttggttttatttttaattatgaaagtaatataatcaaactcatcacaattttgattttccaaaaactggagaaatggaaaaaagccagcccttatgctattacattaatagaaatagccattattagctttttagtatatctaatttccatcttttatccacagcatatttttaatgtgtttattatcataatgaacacagaatttggttcctgcctcgtcccttactgttgtatgacaagcattttttgatgctgcaacgtaatatctatgctcctttttccaaaggctgttgttggatgaagggtctgccactttgtctgtaattgactcaaccagtccacactagttgggcacagagtccatccaccttttcactggtgtacccttgagctctgtgcatacagtcttctccgtattttggatcactttccattggcacgatgtttgatcaaaatgctccctttccctgatcccggtgaggtgtaaccatgggtcacatttttgggtggggtgggtgctacagtagaaaaccactctatcctgggcaggtccacccctcccatcccttcagggatcatctcccaggagctggagtgtttatagtctcaacctggctgtttgcagtcaaagcaataaaacagctagaggggggcatcttctagactgggtccgtgcctaggagaaaggagctgaaggtgtaggctggagtgggctgcccttcctgccctgagccttgcctccagtttggagcaagaatgagcacttccaacagtgggtagaggcaccagggagggctggcatgcaatgtaggaatgagatgaacagtggggaaggggagagtgggtctgagtgtcctggcttcgaggaactcgggttgaggacttgggcagacatggttcagacccctggtttccactggtgaatgcttcttcccttcctttctcccttcccttttcccttctcccctctctggcacttgtcacatgagttcggtggttcttttgcagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggtaaggactttggggtgaggacagtagtgcttcagtaggcaccagtcctagcctgtcctcccatttcaggaacctgagcccatggcttagttctgcttttggggtggggttggtggcccagtgaaggcaggaaggaagccactgttgggggaaaattgtgccatccaggagccctttctttggggttcttgaaccctcaaaggcacaatttagtatctttgccttcctctattttctctttctttgacatttatgagctctgtgaccttggtaaagttattagatttctggatcaagttcttcttcatctgtaaaatggagataaaattttctctgtccctaccctgtaaggattcatgaagataatgaatcaaaggttctaacatagtgtctgcatatattcaaaatggttgctactttttaaatcaatgctattataatttctacactttgggtctctgggaaaataaaagaggaagctaacagtggtgtcatgcatggggactagccgcaagtatacccagcatgttttgatggtgtcgacaagaccagccattgcttaacaaaaacagaagcaccagagtcttttaggacagaggttctccaacctcttggtctctggacccctttatactcttaagaattgaagctttcaaagacctgttgtttatgtgggttatatctactgatatttaccatgttagaaatgaataagaaattttaaaatatttattatctcatttaaaaaccacatcaataaaccaatgaaatgttacataataatgattttttttctgaaaagtaacagtttcccctgcctttgttttgcatttttaagcctctttaatgtcttaatggaagtcagcaggactcttctagccacttctgcattcaatttgtttttaatcaaaatatgtaaaaatagaaatcttgcctcatgaaaatacataattggaaaagacaagacctttcaaaaggtcttaggaccctcaggggtccttgacctgtacttcgagaactattgctctaggctacagcggcagtggggtggggaagaggtcacagacggcttgtgatgaatagacacttcacatcccagaagggaagcaaaaccacagctcaaacccagatcattctgggattacaccattttaccacttatcctatgatcacttctcattttttttttgatgttccatctctgcttttagtactttactcatctatctatctatctatctatctatctatctatttatctatctatcatctatctatctattgcaaacttaagaaaatagtgtgttaaaaagaaaagctagagggcaagtgctaaatgtggcatgactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggtatggagtgtgacggtgctgcctgtgtccctcctgggaaggctgcctgctgtgtgccaggagccttccaggcactggggatctgtgatgaacatagcaggcagggcctctgagacactcaggcacagggagagaagacgcggcagcctcctgtgttttcatggctgcttcctcacccttctcagacctctacgcctccttggagaggccttccctgatcgcccattctaaaatagccacacacttgctattattctctatccccttaatcagtttttctccataccatttattcctgctgatgtttagttatgtgtttttctgtctttccctctagcatgtaagctctgtgagggcagaggtttgttcagaattatatccccgggccctagatagtccctggcacatagcaggcgctcaatatttcttgaatagatgaacagtatctagactgaataaaaatctagactatgggactcagacatctgtcattttttaaaaagcctgatgaggagctggcactgagacccatgttctgatgtacgttaggtcccccgacacctccctgggtgatgtcactggttgggaagaggttgcattaggggctgtgctcgtcggatgatgatgcagcagagttaaaggcttaagattcttttcatgcgcagtgtggtgccttggattggccctccccaggaacattgtccttgtcagctctcaggggcttcttaattagagtcttacctccttcccctttgcctttcccatccccagcagctgctgcagaccttatctttcctctctgatcaaggaaagcacagccaggaatgaagggctgtctgaggatgactgaggttgtcagggtgacatccttgaggacacagaggccagcaggaattttaagagttctgtggggataagatgtcctgaccaaagatctgcttcagggggactagtctgacttgctgtgactgatgtcaaagctgcccacatggctatagaaagtgaatcaaaagtatatagtttcatttgtatttctcttggtccacaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 942 - DNA, 57259 bp, Homo sapiens
gtggacggttggcgagggagtgtgtgtgtgtgtgtgtgtgtgtgtgtgtgtgtgtatccaagtgaccagaaggacgcctggaagaaaccaatgcttgcgggttgctgcaactacagggagcaagtcacctgtgcggggccgagacccccagagtctcgcgctgggaaaagttgtgcggggaggggaggacgtcgggcaagcccgggcggcacggggagcggtgtggaagcccggcggggccagcgcagttgaggtctggggagcccggctggcatctgctccgggctgcggcgcgggccccgcggagcccaggaggcggcgggtgcttccggccaagggccctggcggccgccgcgcccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccggtgagtgcgcgcgaggctgcgctgctgaccttgggccagccccgcggaccctgcggcccaggcgggaatcagcagcgccctggggtctgaaccgcggcttccgccttccctgctcgcagaggcggtggcgctgactccggtccgatcccttgccctgtcccctgttcctgtccctgtccctacccctgcctctgcggtggcccgagccccagcggcctcaggtgagcgggcagcatcccgattccctggcggcctagaatggaatcgcaaggtttagagaaattaagggacctgggacttgccaccctgggcaaagttcctaggtgcttgaggactggctggatgtggacagctgaggtggacttctacctggaggcgagggatgcactggatgatagggtgatgaggtcgtttgaggccttcatccttacctctttggctctctcccggcaagggaggtgtacagccttgggctctggcagtctgctttctgcccttgatcttctggtagctgctttgccagcagagctgctaatggctgttgtaggctggcagaggtccctggggagagttttgagaggccttggagtaggagaggcttgctaactagggtatcatttccccaaactgtatgtggctgaaagcttgatggcgacacatcagcaaaggagctgggtgaaagcaggcagcacaaggagggattttagcatggtcttgagcccctgttggctttccctcaggatgcagtgaccaacatttggccatcttcatggaaaagctgcctgcagctggaacctgcagaggagaaattctttccctggctgtgcagcactaaggccgagtgttagtggagccattgagccagacagacagagcctctgtcacttcacacctctaggagtgttgacagcaggtctggggtagttggcctggcctggctgcagcttcatggggcctggcttgctctgaggatgatggtatggggctgccctctctaggaataatgacacctgcataggtggtggctgggagactctttgacctctcagtcccatccttagctcagcctctgtcttctaaggttctcctagctctcagctaggtcaagaagctctttgagagatgaggttttttgtagttgtttttttttgcctctacactgactggatcactcttcaaatggcctcaaaatctgtctcaggtcttgaaaatgtcatgggcagataacatgtagccttcgggttaacagggagataccctttctcccctaaagctgcccattggcctccatgattcttccaccaagtataataatctcttagttcttctgtatgctggttgcatatctaggacaacagacaattgctttgggcttttgatttgtaaggaactgactggggcatgggaggatgagctcatggctggagtcctggctgtgtacagtcaccgagaagtaccattcataggggagaaggatgttcctcctcctgatctggcttcacatttaaatatgttttccttcttcctgcacccaggtaatagaaacttgggagagtgccaggcacatggtggtgctcaataaataaggttgaataaaaggattcagtgtctagataaaacttcatgttcattttcctagttcttctctctcgtatctgatatcataatgatgatgacaatgatgttggcagataatgcttataaaacacatactctatgccaggtaccagtctaaacacttcacttatgctcattgtcatggcaacctatgagattggctttttattatccacacttcatagggaataaaaccgagccacagaaaagttatttaacttgcccaaggtcatacaactaagtggtggaacaggattcaaatgcagggagtctagctggagttttttttgttgttgtttgtttgtttgaaatggagtctcactctgtcacccaggctggagtgcagtggcacaatctcagctcactgcaacctccacctcccgggttcaagcgattctcctgcctcagcttcccaagtagctgggattacaggcgcccgctaccatgccaggctaatttttgtgtttttagtagagatggggtttccccatgttggccaggctggtctcaaaactcctgacctcaagtggtctggccgcctcggcctcccaaagcgctgggattacaggcgtgagccaccacactcagcctgagtctacgtttttagccatacactctactcattcctgagattgccataggtggattgatctattataaatagctagttcacttgttcattgttttatgcattcattcattcaacaaatacttgctgaatgtcgaccatatttcaggtatggggatacaactgtgaatgagacaggcgagatttgtcatggagctggtatttagcaagtgaatcccctttgtccaactccttgtgtgagtcacacacacctcacaaatgagaagaaaaatgaacccctctatgcaagctcatgcctggcttttggggaggagagtgatatctttctttttctttttctttttttttttcttgagataaagtcttgctctgtcgccaggctggagtgcagtgcagtggtgcaatgtcagctcactgcaacttctgcctcctgggttcaagtgattcccctgcctcagcctctcaagtaggtgggactacaggtgcgcaccaccatgcccagctaattttttgtgttttagtagagatggggtttcaccacgttggctaggatggtctcaatctcctgaccttgtgatccacctgcctcgggctcccaaagtgctgggattacaggcatgagccaccatgcccggccgatatctttcttgatgagacataatttgattccgtcctctcctgtcttttagagtttgtaaggggtgcttaagtgataaaaggggatgcagtctagtctcgggcaggagaagcgggccctgtatctggttatcataaattgtcttgatgtttgttcgaaagggaaataaggctttgagcttgggatcagtgctcttcagtccacagagacatcttggctgcaagaagcagcaacaagttaggctcaaggtggaattgtgaggtcctgagaagagcttgctcttctgggacagaactgtatttttcttctaaactgcccatgttctggggagtcttcccgccttttggcttcagcaggacccttggtcattgttacaacctgtgtcatcttagtggagctgctgctggtttctgtctgaacccgatgcaatgggtctcatacctgtaaactgggctccaggaaggcagctttctctaagttggaaaatgaagactcaaggtggagggtgtttcccaaagccgataccacaagatattaataggtgtttttttcctatgacagcagttctaggatggtcaaataagtgcgtcgggttaaacaaagttaagcagctttctttactgcaggacttctcaggtgttgaatttgctagtagaaactgtgcatgaatacccataagggactacaggatgcagtgttttccaagccttctgacctttcatgttctgcagactgcactttgaaaaatgcttgtttagactaaggctagctgggatccggttaaaggtgcagaataaaattccctgaacgtgtcggacttaaatccttgggctggaatcctcccactgcagtccccactctacctcccctttccccaaaacactagcagaaaaagtcatctgcccctcctccttctggcagaatagtactaagggcttggatttttttctcatactgtaagttcatttaattgtttaatgaataaatattaccctccctctaggttgcttgtagcctgctggttgcactgtttatgaaacagctgtgaggacaggtgggccgtaatctctgggtagctaaagcccagcagcagcccgaggatcatgtgtcaaccctgtaatactgctctgtgcacacaggaattatgatgtgagctcagtaagacacaacctcacgattggacatgcggaggtgactcaggcccaagtcagggttacagctagcctcccggtaaacaactgacccatccttcctgagctcttctccccaggatttcaacagcaccacagaaatagccattttgctcatggttatttcccaggaccacaggatttgcctaagtcactgggaggctatgtgtctgttctgagccttcccactctcctaaagggcagatgaagatcagagctttgcaccctgtgatgccattttaatcaaccctgcttggttttagaggattgctcctgtgggtcacttgaggcaggctccaccttccccaggaggagtggcagagtccagccagcgctcggagctggaggcccacgtgggagcagtgagcggctgtaagcaggggagggtttggggtgggctccggtgggtcagttggggtgtactccttttctgtgtgtgtggatgggggtgggggttctggtaaagcttatcaggcttcgcagtcacctgtgatgtgggcttccttctgggaagaaaggaaggagtgggatggggctgtcagcttttcatcctagcctgcccctgtcctctgtccgcctctgtgctgaggcagttcctgctccctgagtctctgtcctttcctgggaaaggtggaagcagttcatggtctttccctttcagaggaggaggggatggaggggattgtattagcaactgggattgaagctccccctggcagttatggggtgcccttgggagggctgctttaggggggctttctgagaagaggcaggtcgggctgtacctgagaccaatccccttgataaaatgcagccaggcctgaagcacgttcagaacggaagcagcaaaggtgatgatatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtggcactgggcttcctttctggagggactgtggcaccatgaaaagttactgtttgttgaaactggcagtgttttagaactttctaactttgggacacttcttcaagttcatcagagcgtgttgcatgtaacagtgagataagctgtatcattggctgactgatgctggtgaattcacagctaagcctcccaagcctgctggcttcagctgacaaagggttggaagccaggcgtgaacatgcagctggagctgaagctctgcttggcatctgcagagtgagctttccttgtcaggcctggcctggcaggtgtctggagggtctgagaggagagacactctggagggacgggttggcaggtgggagctgtctgccaaggacatccagaaggcagcagatgtgggggcagctgctaaggcctgcagcaccccaagtgggttacttggtccatactaagatatggaattaattattttgttgtggttgctgttgtttcttgcttttttttttttttttttgagagaaggtcttgctctgtcacccaggctggagtacggtggtgccatcatggctcactgcagcctgcacctccaggactcgagcaattctcccaactcagccttccaaatagctgagaccacaggtgcatgccaccacacctggctgtttttttttctattttttgtagagatgaggttctgacatattgcaccaggctgatctcgaactcctggcctcaagcgatcctcttcagcctcccaaattgcttggattataggcatgagccactgcacccggtcttggaatgaattatctaccaactatttaagacactggtagtagttctgcggaagatttttatgggttctgtaaaacaaaaagggttctgtatgttaatgttactctatgatccttgattttaatgagccttatgaatgtgagttgaggggctgtggaatgcaacatctcccaataactgaccacaggacctgttttaccagcaacaggtatcaatttcttatggcatccagtttgggaaaggttgatttaagctaaagagaaaggaagatatgttatagaaagctgtgtcctgaaaagtatttttagttgattagagcaagctaaaaatgctttgtgcgctggtatgatggctcacacctataatcctagaccctgggaggccaaggcaggcggatcacttgagaccaggagttcaagaccagcctggccaacatggtgaaaccccatctctactaaaaatacaaaaattagccaggcatagtggtgtgtgcctgtggtcccagctactcgggaggctgaggtgggagaatcaccggagcctgtgaggtcgaggctgcagtaagctgtgattgtgccactgcactccagcctgggcaactgagaccctgtctctcaatcaatcaatgaataaatgcatgcttcatgagcaaacatggcaggatctggcataagagccctcagacatcaaggacttccctcccacccaaatacccattgccaagggagcctggttgggggtgtctgggtcaggcctgtgtgtgtctgagggcatgaaggaggtaggaaggtgctgctggtggtggatggcttctgtccagggtaggagctaacacagagataggtctgaatggtgaaactccctttggcctggcctctcaatagtgtgggttaggctgatcttgaactcttagcctcaagtgatccttcctcctcagcctcccaaattgcctggacaacatggcaaaacctcatctctaaaaaaaaaaaaaaaaaaaaaaattagccaggtatggtgatgctccctccctccctcccttcggcaattaaggagggagccctaattgccaaaacctgccagaaaaagaagtttgttttcctatttttctctcttttcatagagtcttaagtctactcattttctttctattctctttgtatttgttaaaaatggcattataatagcattcatcatcaaaataaaatatcctctcacacacaggcagccctgccacctggtcattttgactgcgtgaatctcttgcaggtcttgcccataaagggatgcattttcctttcactgtaaataaagcatgggtatggttctatgtattaattttttcatttactgtatttttatttttttatgtgattgcaccatcctcataatcataattctgattacttaacatctttttcaagtgagtatgctctaatttaggcattttaaagctatttatgtaaataatgcaggtaaatatccttgtgcttttcattcttaggattctttttttgaaagaaatttgtagaagtaaagttgcttagtcaaatggtatggtgctttatggcatttgcggccttttgcctgggctgttgggttgcatatcttcttctgagatgcgatgtgaggttttgggatggtgcccttgattggtggccttggaataaggggggaggtgaggatccagtttcgtttcagcctgatggagcctcctgggtctggttctttgtgctgttccagactttctctcccctgtcacctcctttgatggcctccagcttcccccctctctgctatcaagacatggaaatccccacaggcagctctgttcctcttcctttttgcagaggccaggcctcgctgtcttgatgtctgctccccagacagttgtgtgttgacaggctgttccccaccagctccctcccactcctctcatcagggagtggcaggtccttgggtctcagagttaagggagccacagacctcactctgattgcctgttgctagcctgctttcttccttcctgtctgtgtcatgacttagtcccacatgccactcagactcagagcagcaagccctcctcaggcaccggaaatctctctggtacctagaattatgccacttagagctgagagggccttagagaccacttagttcaatccctttatctcacagatgagaacattgtgaggccggagaatgactgtcccaagatggcctagtgtgttcccctcccctgtagctgcacttctccctgctggacagcagcagggctctgtctcatctccattcttgtctgtctggtccacaaaaccacttctctctttaaaccaactttaaagaaactgtggtcataggtagatgggaaactcctcttccagagctgctcccaacgagggtggcttgtcgaaaagggtgcagtattaatccattccacaagtgttatgctggggactgtgaggagcccctgcccggacacatacgtggacaaagagaagcagcacagcatggtgggtgaggggacagaggcaggaaccaggtgcctgggttcagatccctgagctgaggatcagagaggaaagggatgagagagaaaggctgagaacagcacaaatctctgctgacttattaaaagtgtgaccctgggcatgttagctctctatgccttcattttctcatctgtcaagtgggaataataagattaactgagttaataagtatgaagttctttgcagagtatatatatgtatgtatacatatataaaatatatattatatataatatatattatatataatatatattttatatatatatatatattttatttttaaaattgagacgaggtctcaccctgtctcccaggctggagtgcagtagtacgatcataactcactgcagcctcaacctccctggctcaagagatcctcctgcctcagcctccctagcagctgggattacaggcatgcatcaccatacctggctaattctttaaatcttttttagggatgaggttttgccatgttgtccaggctggtctcaaacttctgggctcaagcagtcctcttgccttgacctcccaaagtgctggtattacaggcgtgagccaccacacccggccccagagtatactttttttttttttttgaggcagagtcccactctgttacccaggttggagtgaagtggctcaatcttggctcattgcaaccttcacctcctaggtttaagcaattctcttgcctcagcctcctgagcagctgggattacaggtgcctgccaccacgcctggctaatttttttgtatttttagtagagacgtggttttgccatgttggccaggatggtctcaaactcctgacctcaggtgatctgcccgcctcagcctcccaaaatgctaggattacaggcgtgagccaatgcgcctggccagagtgtacatattaagtgctatacaagtaattgcaaaaaaggaaagaaataaggaaatgaagaaagcaagcaagcaagaatgaaacccaaccaaccaagcaggtggttgaggccagtgactgttagtaaggaatcagtatgcgaggaggtggatagagaaagcttctttgagggagtgagttttcagctgggtaaagagtgttctaaaacctttattttatttgctgtgtcttgttaggaggttccagagggtttggaactgcaatagcagattctttctcttcagcaaaaggccttgatttatgtaatgaagaatgcagctttggatttcccagggctctgctgtaatcttgtgcgaccttagctgttaaagcctctgtgaagtgggggagtgaggtttgattattgttgcagctataacagtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccaggtgggcctggccctcacttcagtgccttctcttccccggtgctggtgactcagggcatcctgcaattcatgcttgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttccaggttctcccagtggctgccatgggccaaacctagccagaatcctgctggcacacttgggaaacacaggagaggatgaggaatggatctgagggcaaacaggcccaggagcagcgcaagtgctatgaaagagatgaataaggatgagatggggttaggggagagaaaggccgggaaagagagagaaaaaatccttttttagactgggaagtcagggaaggcctctccaaggagatgacatcttagcggatgcttcagggtataaagaagctagctatgtggccttccagatagaagaatcagctagggcaaaggccccccagtttcttccagaaggcccatgtggttagaggtctgttaaaggaagaagtgctgtgaccagggctggaggacttgtggggcccagatcagactggccttgtgctccctgataagaagtttggattggagtctaagtgaaatgagaagccctcatcctttcacagtttatctcaccctgggctttatcagattttctgcctgcccggtaccctgcaaacatcaatagttgacatggtagacctttgagccctctccgacctagtctgtgatcacactagatactgcctcagttttaaaggcaagtcttttcctttcttggttgtgtagaagctcgcattttcttaactcgtttggaaagaagtaaaaagttgactactggtgtaaaggcaagaacagagcttcaccactcataagaccagtgctttccttccttgaaaggatggtgagcccataaaggcaggagtcactggtgccattggttaacctctgagtgccagccttgtgttggataaggtggggtggccccagccccagcagtgtgctcatccctggagggtcaagaagagtatgactgtagagaccctcattcacactccgtgggtggaacagaagggctgacttcatcaagtgaatggtctgcagggccttctgtgtgttatgaattgagcatttgagacccttaacaatgagaggaaaagaaatcctggcattttttattactaggaacaataagtttctggaaccagtttccactacagagtgacactgggcctgacatctgctgaagcgactgtgctcttctcaatgcccagactcagggcaaaatggaagctttcttactctaagtcttaatggtgctctgtggtttccagaaattcccctgcaaacttctctccaaaaactttgttctgtccttgcctaggttatggtgtcttagtttgcatctgtctgcgccatttgactagacgctccttgaggactggatccattgtggaacttagttggtgggcagtggatgtctggcagaggaagacatcctgcctccccattgccaccatggacactacatcagggtggctgcaacttcttggacctctgtgttctgccactcactgtcatgctctgtgactttggggaaattaggaaacctctctgggcctcagcctcgtcctcatctataaagtggagatgctaacagctaccttcatggggtgttgtgaggaatgagggaatccacaggtaaaaggcttcggacagtgtctggttatagtgcatcccgagtaaatataagtgatttctctgacttcctgctgctgagacagggaacaatagcagctcctgccattgaatacttactatgggctaagtactagcctgtgtaggttggattcattctttaattctcacatcgagcttatcaaatggatattcttagtattctgattttgcagattagggaacgaaggctcagagaagttgaatttactttcacaaagacacatagtgagtaaatgacagagcaagaactagagcccatatcttttgaatctagaccccacacttcaaccataaggctatcccctcttcaggtaggggtggagtcttcggttccctggtctgtagaccctggaatgacactaggtgctgctccctagaatgtaattgttgcttctaaatgaaatggagggaaactggtcaaagctcccgctctgtccatcggcttctttcctgaaaaaaagcttggtccctggactgtcagatgccccagcatcctcctctggggtctgcccatacccaattttgtcttttagtttctcttctcactagaggtgcctttatatgtaaatgttcgaaagttaacattttcatggaggacaccctctccccagctccctctttgtctgtggcacctcccatcccatctcctatttattcttactttacacagaattctataatctggctatattgtttcttatcccgtggcagatttaaagaagcaaattagaagcagggagagagacttctacaggcagggtcacagaggtgatgtgtggtgattataagcctgggctttggggtcagacctattgggttcaagtggcagccctgtcacttactactgaatggccttggtcaaagctcttgactgcctgagctggtttcctaaactgcaaaatgagaataataaaaggacataccttgtgagaattaaatgagcgaatacacaaaaaatccttagcgcagtgcttggagcaccattaatgttcctgttttgttattgttgttattagacagtcaacagtgagagaggaaacaaaataattatgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggagtttttttttttttttttttttctgtaccccagtggcgcctggagcgccagcaagacagaatcattcactcccctggaaagggggctaaagccagggagccaagtggtctggcttggcaggtcccagccccatggagcccagcaaactaagatccactggtggccaggcgcagtggctcatgcctgtaatcccagcacttagggaggccaaggcgagtggatcacctgacgtcaggagttcaagaccagcctggccaacatggtgaaacctcatctctactaaaaatacaaagattagccgggcgtggtggggggcacctgtaatcccagttacttgggaggttgaggcaggagaatcgcttgaacccaggagaaggaggttgcagtgatctgagatcgcaccattgcactgagcttgggtgacaagagcaaaactccgtctcaaagaaaaaaaaaaaagatccactggctcaaaattctcactgccagcacagcagcagtctgagatcaatctgggacactcaagcttcgtagggggagggtcgttggccattgctgaggcttgagtaggaggttttaccctcacagtgtaaacaaagccaccaggaagttcaaactaggtggaacccaccgcagctcagcaaagctgctgtggccagactgcctctctagatttcttctctctgggcagggcatctctgaaaaaaaggcagcagccccaatcagggacttatagataaaacccccatctccctgggacagagcacctgggggaaggggcagctgtgggcacagcttcagcagacataaatgtccctgcctgacagctctgaagagaccagcagtcctcccagcacagcgttcaagctctgctaagggtgagactgcctcctcaagtgggtccctaacccccgtgtatcctgactgggagacacctcccagtaggggccgacaggcatctcatacaggagagctctggctggcatcaggcaagtgcccctctgggatgaagcttccagaggaaagaacaggcagcagtctttgctgttctgcagcctccactagtgacacccagccaaacagggtctggagtggacctccagcaaactctagcagaggggtctgattgttaggaggaaatctaacaaacagaaaggaatagcacatctaatcagagaccacatccgaaaatcaccagcatcaaagaccaaagatagataaatccacgaagatggggatgtaaaccagtgcaaaaaggctgaaaattccaaaaaccagaatgcctcttctcctccaaatgatcacaactccttgccagcaagggaaaaaaactggacagagaatgagtttgaccaattgacagaagtaggcttcagaaggtgggtaataacaaacgcctctgagctaaaggaacatgttctaacccaatgcaaggaagataagaaccttgaaaaaaggatagatgaattgctaactagaaaaaccagtttagagaagaacataaatgacctgatggagcagaaaaacacagcacgagaacattgtgaagcattcacaagtatgaatagctgaatcaatcaaacggaagaaaggatatcagagattgaagaccaacttaatgaaataaaataagaagacaagataagaggaaaaaaaatgaaaaggaatgaacaaagcctccaagaaatatgggactatgtgcaaagaccaaacctacgtttgatggatgtacctgaaagtgacggggagaatcgaaacaagtggaaaacactcttcaggatattatccaggaaaacttccccaacctagcaagacaagccaacattcaaattcaggaaatacagagaacaccacaaagatattcctcgagaagagcaaccccaagacacataatcgtcagatgccccaaggttgaaatgaaggaaaaaatgttaagggcagccagagagaaaggtcaggctacccacaaagagaagcccatcagactaacagcagatctctctgcagaaaccctacaagccagaagagagtgggggccaatattcaacattcttgaagaaaagaattttcaacccagaatttcatatgcagccaaacaaagcttcataagcaaaggagaaataaaatcctttacagacaagcaaatgctgagagattttgtcaccaccaggcctgccttacaagagctcctgaaggaagcactaaacctggaagggagcaaccggtaccagccactgcaaaaacataccaaattgtaaagactatcaacacttcgaagaaactgcatcaactaatgggcaaaacaaccagctagcatcatgatgacaggatcaaattcacacgtaacaatattagccttaaatgtaaacgggctaaatgccccaattaaaacacacagactggcaaattggatgaagagtcaagacccaacagtgtgctgtattcaggagactcatctcaagtgcaaagacagacataggctcaaaataaagggatggaggaatatttaccaagcaaatggaaagaaaaaaaaaaaagcagaagttgcaagtttaacctctgataaaacagactttaaaccaacaaagatcaaaagagacaaggaagggcattacataatggtaaagggatcaatgcaacaagaagagctaactgtcctaaatatatatgcacccaacacaggagcacccagattcataaagcaagtcttagagacctacaaagagacttagactcccacacaataataatgggagactttaacaccccattgtgaatattagacagatcaacgagacaaaattaacaaggatattcaggacttgaactcagctctggaacaagctccaacccaaatcaacagaatatacattcttctcagcacctcatcacacttactttaaaattgaccacataattggaagtaaaacactcctcagcaaacgcaaaagaatggaaatcataacaaacagtctctcagaccacagtgcaatcaaattagaactcaggattaagaaactcactcaaaaccacacaactacatggaaactgaaaaatctgctcctgaatgactactgggtaaataaggaaatgaaggcagaaataaagatgttctttgaaaccagtgagaacaaagacacaacgtaccagaatctctgggacacatttaaagcagtgtgtagtgggaaatttatagcactaaatgtccacaagagaaagcaggaaagatctaaaatcaacaccctaacatcacaattaaaagagctagagaagcaagagcaaacaaattcaaaagctagcagaagacaagaaataactaagatcagagcagaaccgaaggagatagagacatgaaaaactcttcaaaaactcaatgaatccaggagctgttttttttttgaaaagatcaatgaaataaatagactgctagcaagactaacaaagagaaaaagagagaagaatcaaatagacacaataaaaaataataaacggggtatcaccactgatcccacagaaatacagactaccatcggagaatactataaacacctctatgcaaataaattagaaaatctagaagaattggataaattcctggatgcatacactctcccaagtctaaaccaggaagaagttgaatccctgaatagaccaataacaagttatgaaattgaggcagtaatgaatagcctaccaaccaaaaaaagcccagaaccagacagattcacagccaaattctaccagaggtacaaagaggagctggtaccattccttctgaaactattcccaacaatagtttggagctggtaccattccttctgaaactattccaaactcattttatgaggccagcatcatcctgatgccaaaacatggcagagacacaacagagaaaatttcaggccaatatccctgatgaacatcgatgtaaaagtcttcggccgggcgcggtggctcacgcctgtaatcccagcactttgggaggccgaggcgggcagatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtcctcaataatatactggcaaaccaaatccagcagcacatcaaaaagcttatccaccacgatcaagttggcttcatacctgggatgcaaggctggttcaacatatgcaaatcaatcagcgtaatccatcgcataaacagaaccaatgacgaaaaccacatgattatctgaatagatgcagaaaagtccttcaatataattcaacaccccttcatgctaaaaactctcaataaattaggtattgatggaacgtatctcaaaataaaaagagctatttatgaaaaacccacaggcaatatcatactgaatgggcaaaaactggaagcattccctttgaaaactggcgcaagacaagtatgccctctctcaccactcctattcaacatagtattggaagttctggcaggggcaatcaggcaagagaaagaaataaagactattcaaacaggaaaagaggaagtcaaattgtctctgtttgtggatgacatgattgtatatttagaaaaccccaccatctcagccccaaatctccttaagctgataagcaacttcagcaaagtctcaggataaaaaatcaatgtgcaaaaatcacaagcattcctgtatactaataacagacaaacagccaaatcatgagtgaactcccattcacaattgccactaggagaataaaatagctaggaatccaacttacaagggatgtgaaggacctcttcaaggagaattacaaaccactgctcaaggaaataagaaaggacaaaaacaaatggaaaaacattccatgctcatggataggaagaatcaatatcatgaaaatggccatactgcccaaagtaatttataggttcagtgctatccccatcaagctaccattgactttcttcacagaattagaaaaaaactactttaaatttcatatggaaccaaaaaagagcctgtatagccaagacaattctaagcaagaagaacaaagctggaggcatcacgctacctgacttcaaactatactacaaggctacagtaaacaaaacagcctggtactggtaccaaaacagatatatagaccaatggaacagaacagaggcctcagaaataacaccacacatctacaatcatctgatctttgacaaacctggcacaaacaagcaatggggaaaggattccctatttaataaatggtgttgggaaaactggctagccatatgcaaaaaactgaaactggactccttacaccttatacaaaaattaactcaagatggattaaagacttaaatgtaagacctaaaccataaaaaccctagaagaaaacctaggacattcaggacataggcatgggcaaagacttcatgtataaaacatcaaaagccatggcaacaaaagccaaaattgagaaatgggatctaattaaactaaagagcttctgcacagcaaaagaaactaccatcagagtgaataggcaaccttcagaacaggagaaaattttttcaatctatccatctgacaaagggctaatgtccagaatctacaaagaacttaaacaaatttacaagaaaacaaccccatcaaaaagtgggcaaaggatatgaacagacacttctcaaaagaagacatttatgcagccaacaaacatatgaaaaaatgctcatcatcactggtcattagagaaatgcaaatgaaaaccacaatgagataccatctcacgccagttagaatggcgatcattaaaaagtcaggaaacaacagatgctggagaggatgtggagaaataggaatgcttttacactgttggtgggagtgtaaattagttcaaccattgtggaagacagtgtggctattcctcaagaatctagaactagaaataccatttgacccagcaatcccattactgggtatatacccaaaggattataaatcattctataaagacacatgcacacgtatgtttattgcagcactatccacaatagcaaagacttggaacccacccaaatgtccatcaatgatagactggataaagaaaatatggcacatatacaccatggaatactatgcagccataaaaaagatgggttcatgtcctttgcagggacatggatgaagctagaaaccatcattctcagcaaactaacacaagaagagaaaaccaaacatcgcatgttctcactcataagtaggagttgaacaatgagaacacatggacacagggaggagaacatcacacactggggcctgttggggggtgaggggctaggggagggatagcattcggagaaatacctaatgtaggtgtcaggttgatgggtgcagcaaaccaccatggcatgtgtatacctatgtaacaaacctgcacattctttacatgtaccccagaacttaaagtataattaaaaaaagaaaaaaattaggatatagagggaaaaattttattagttgaaaaatttggctatctaggacagccgcttccctagaatgttttgagtgaaattgagaaacatatgtgctttatgaattgagcatagcacagctaaagtgttgctaagtcacttcattttatgaaacttgtgaaaataagaatggggaactttttaaacattcaggatcattgacaaaggagcttcatttgaaatagtcaatctatccccttttaaagttagggagagattgggctgggcgcggtggctcacacctgtaatcccagcactttgggaggctgaggcgggtggatcacctgaagtcaggagttggagaccagcctggccaacatgtagaaaccctgtctttactaaaaatataaaggttagctgggtgtggtggcacatgtctgtaatcccagcaactccggaggctgaggcaggagaattgcttgaacctgagagtcaaaggtttcagaaagccaagatcaccccactgctctccagcctggctgagggagggagactctgtcttgaaaaagaaaaagttagggagattgggaagccgaggtgggtggatcacttgaggccaggagtttgagaccagcctggccaacatggcaaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggagatgagtggagattacagtaggccaggaggggttgtggggaagggaggatggagaaagaaggggcaggtttccagaggagctcagggagagacagagggtggggctgtgagttttcacacctgattggctgcaaagtgttagaatcaaagttacacccacctggccaggatgctggtcatctggctgcatatgcggagtgagtgatctctgtgcgcccctgctctctctgtagggacccctgttatagtgcccatcgtgcagcatatttctccagataggctgggacctctggtctcaagtacagggaaggtgtcagcccctcttagttccctccttagatgggggtcccaattccaggtgagccaatgcaggggcagcgtgagcagcagcagtgtgagcctatggaagtggaggatgcctgtcccgcctgatggcattcagattcccagtgtttgcaaaactctgtgctggtttgtgacttctgattccaacctttattttagcgtaacaattctcatgtggaggggctgccagaatgagctgagtgtgcgtgggggaggagttcaaaccagcctccatgttctgaaatgtcccccctctgaccccattgctccactgctcccacccctagtctggattaagtgtctcctctggggtcccaaaatatccagggcatctcattacaccaaccacactgtatgataatctgtggaactgtctgggttcatctcagccatcacagtcggcccctggaggcgggagttatatcttatctactcctctacacccagggcctggcacacagtagtttattgaatgaagtggggtccacgtgtggcccccagctcatagtacacatatgagagcctggtgaaaggttggctccagtgcccctccctgcctagtagtcatctggacagaccacacagggcagtgggcttcagatggcccctggtaagatgctggctattctctaggagagcaaggtgggcctgaagggctcctcactttagcatttgagtgctatatagggaaggccctgggagcctgattccccagagcggaggagggctggggagtggagcagagtaagggaggggacttagtgactgtcaggggcaaccaagggccatagagcaggtggagcaccagacaggtgctgggaggtaagatgctgtaacaacagcccaggtgacctgatcaactctttgtcttgtgggcctggttagcaagaatgtccttgtgcgtcaagaggataaatctatttcagggatgacaaaactgctcctggccctttgagccctcaggcttggcctggagctggtgtcctcacagccccacactctgctggctccttggcaggagtgtgcttctgccaggtgcaagtgtgggtgggggaaggagggggtgtgccagctgtagcccagcaaatgctggcgccccaggggctagtgcaaggtgcagcaggtgagatagtggacagacagaccttggcccatcagaaggaagtgctttctaacaggggcaccagatcagttttgttcatacacacactcatagacacactcactcactgtattagtttgcactgctataaagaaatacctgagactggtaatttataaaataatgaggtataattggctcatagttctgcaggctgtacaggaagcatggcagcatctgcttctgaggaagcctcagggaactttgactcatggtgaaggcaaagcaggagcaggcgtcttacatggtgggagcaggagcaagaggcagcgagagtgggtaggggaaggtgctacacacttttaaatgcccagatctccatgaaaactctcactagaacagcaccaaggagatggtgctagaccattcatgaaggatccacccccatgatccaatcacctcccaccagcccctacctccaacaccggggattaacatttgacatgagatttgggcagagacatggatgcaaaccatgtcgcacaccctctgacacttacgcccacacgcccactcactcagctccaaccctctacctttactggctgggcctcggttgtatagaatggatgctagatatgggcctaggggaggtagaatttctaaaacggcccctgcagatgtccctccttaatctccagatgcagtgaataagatgagttatcactcctgtgatgatgttatggaatatggcacagttgaccttaagataggggggttattggtaggcctgatttaatcccatgagcccgtaaaaatagagagctttctgagtgtaggaggggagggcagagagattcaaagcaacagcacaatgaccactcctggttttggagatgaagggggctatgtgcagggattggagtgaggtcaataggagttgagagtgacccctggtcaaagccagcaagcagcctgggactccagccttgtgggcactagacctgaattctgccaacaaccggaatgaacttggaagtgaattccttcccagaaactccagacaagagtacagtgtggctaacatcttgattttggcctcttgataccctgagcatagagcccagccaagcccacccagacttctcacctatagaactgtgagctaataaatagctgttgttttaagccatcaagtttgtggcaatttgttctgcagcaatagaaaacaaatccagggtcatccttgggctccatatagcttttccaatttcctgagatacaagctgtggttaacttccagttcttccaagctcaaggggagtgagccctgaggagttagcctatctgtggttaaacctatcccttgtgcctacagagtctgagctcctggcccgcagatgctcatatgtgacaatctggagctcaactgaagaccaaggttgtcgccataatggatatccccaggaaggagaattctttgggcaccagtttgtgggtactagcttcctcactggggcagaagaacattcctaggacaagcctggtaggctgttggcttaggcagcctcccagcatttgggctgtagtgtttttttttttgtgtgtgtgtgtgtggtttttttttaaactttcttagctgttgctcaccttagatgtcacctgttgcttcttgttggtaggaccagacctcaggcagccttggctgaggcatttggaggtgaggttgcatggaaataaaaacagtgagctggaaggcatgtgtgagtgacacagaaaccagaatctcatgcgtcccagctgaggtcagaatgtgttggggagcccaaagtaatggctcttcctctgggtgtgggcattcaaaagatgccaaagggagaacctcatcctcaaggtgaatccgcctctgaggagtgactgacaaggtggcatccctggggcaggatgcttggctgagctccatttgatggaggacagaccagagaaagctgaggctgggggctcccagggctcaggttgagtttcccgaagcagtccagtgcatcacttagcaggaccaggggcaaggggaaggtaaattcctgaaaaggagccacctctgtcttgcaggttaaaatagccttgtcccaaagatgtgataacacagggtaggcaggtgagaaccagagggccatggcaagcactgggtgtgtaaacacgggaggagaactgtggttcttgaaaactcggcagtgaggatacctggccacaggccaagaggaagagagctgcttctgggtaagccctgaaacttatttggggatcaactgatttcttcaggcctgtaggtatcacactagtacctggagaggaggagggctctagtgggtcacagttgtcactgagtccttgctggtggctgtggttgtggtagaataaatactcaggaagctactgggcccatggcacaaggtagggcaggtggtcagttggtttctggcatttgacactgtgggatggcaccgtggggaggccgggttccactgggggcagacagaaacatgaggtaggagaagagtgctgatggcctcaccttaatgctgggtaatttttctgcagaagagacttgcagtgacataatctgatgtctgtttcatgaatgaggaaggtagagtcatcacaaatcagccttgcaaataagcatgggcttgtggcattttaaaccaaccttgggcccaagagccagtgtaatcatcttttggtgccaaggcaacaggtccagagggacctgaatttggtgccgatcaatccctctccccaaacagaggtacatatctgtgcctgctctagcagcggcagtcaggatggtacacggcgggctagaggagggagcagcagggctggaggctgggtggagcagccactgtgccatgggccgtgtgactttgtgccagccctttcccatctctgggaaagtgtctgtgagaagtaggctgatcttgcagatctccttggcacccagtaggtctgctgccagccatggggcctatgatgcctgtaagcttggatggcggtcgctagtccacggtcctgagcactgtctcgactcctttgtaaaacaaggagattggattcattgagcatccctctctcttctggctccaatgccccaaatgtctaactgtgtgaaatgcagtgtgattgtctctctgtgaccctattcctggtcctttctgagaccgttcatatgttgggactgagagtttgtgttatctgaagccagcatgctgtccacactgtggggaaagcctgcatgatttgctattgtcctcccctctagtgccctgtggttttagagcccctgccatgtggtctgccatttgtctctctgtctcctagggcatttgcctgctttaatcttctgtgggctgtgcaaacagccctgagcagtgcatggtgaccacaggtaggggtgtctggagggccgtgttctatctcaggcagacatgtgtaagaggaaggcatgaataattagaaacttcttaatggtagggccagcaccagtgattaatcatagcaaaattctcctgccacgcacacagcaaagagtctttatcactcaccccaattagcttctgatgtctcccacttttccttgtccttggctcttagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccggggtaaggcgtctgtgagagtgttgaatgtgccttgcatgcaaaggccaggggccccatgggccacagggtcgtgcctccctctggagcctggccctgtccgtggatgtctgggagaaggtgaagaggaggcacaggagacaaggagggccctagcagaggttgtggggtgtgggtgtggtgtctcggtggctgcctgttccccgtgaggagggtcccggggtgcaggctggcacactgtgtctgtgactcgtaagttccacatgttctctaagtccagaaagctggaattggtccctgtagcctgttgagaaaggtgccagcttgggcctttcagtgttgccaaatgtttagtagattcaaagccatggtactgagtggtttgtgtgaaattagttgttgctaaatcatctcttcttatatgtaggttcaatacccttaaatataggctagatcccttcaaccaggaagagagaatcttgtttagaaattgagcaaattggtttacactaagtcaattaacgcagtcactgaaaatgtgctaatttcacctgattggatgatgcattttttatgcatgtctgcttcttggagagaaatatcactgagttagtgccagggttaagtttggctccatctccctggccccaactcactacttaacgcctcagttggcttcattagtctctttttaacagtagctgtagaaaatatggtgaatctgagaaagcaatgcagcttattgctcttcctataaaatttcccctagctttcaaaaatttttttggttatgtgtaatggagaacacttgcagatggtacaaaatttaaaagatacaaaaatggtatcaattattcagccacccattctcctcctcagaggcaaccactggttttagtttcttatgtattctcacatatatggtctatgtacctacaattatttatgcatacatagtttatttacttatttttacaaaaatggtagtttacaatatacattatactgcatcttgcattttccacttaacaatacatcttaaagataatgccatatcaatatataaagaacttctttgtccttttaaaaaatatgtacatagtattcctttatgaggatatatcatagcttattttaattaagttcccatggatgggagtttaggttgggttggaaacaatgcaggccttgtctggagatcagcatcctgaccatgagtctttggtgttcacccaacctgaggcaggtgggcagggcattggaaagcaagagtcgaggtgggtcggccaccagctgaatgggaggatgtcagcctgtagcatataatagcttctttctcccagtctcctggctggcacagagtagtgcatggagcacctgaactgggcaactggtcctcagaaagctaagtgtctgtgagaggcaggctgatcttgcagatctccttggcacgcagtaggtctgctgtcagccatggggcctgtgatgcctgtaagcttggccggtggccacgggtccacaggggtcctgagcatcctctctgatgtccttagccatggcatgagccccttgtcatgctgagtccattggttccccagagaaagaatttggcttcgttgttggcagggacatatttttgtctaggatgtcggtgtctgctcacctattcctgccgctctcagaagccatccactggaagatgtaaaaggaattaacataccttatggggacatttggaggcaggaaaggagaatctaccatcgtaacaaaaagtcttgctttttgtatttagtatttactaaatactacttcttagtagtatttagtaaaagtataaaaacatgcataggaaaaatatattcagacttcttccctctgaggatggggtagggaggagagtagagttttagctgtatctgtgatgatttatttctttaaacctgtgagaaatttgaaagaattatgctaaatattattgtcagctctagaaggtaggttatattatctttggtgcctgtctgtatgtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtcttaaactcctgggctcaagtgatcctcctgccttggcctcccaaagtgctgggattatagatgtgagtcactgcgcctggcctcatgtggcatatttaaaagaacacaatcacacagtaaatgccaaattggtggtagggtggatcggggtgggagtaggaacagagggcatgttccctgggaagacatgtaggctctggtgtcaaacacacctgcatttgtatctgggctctgtcaatttcttgggattttgggaaagatatttctctaagcctcactttgtaaaatgtaatctgtaaatggaaatgcaaataatacctatctcccagggctgtcgtgaggattaaacaggagaatgcatgtgaagtacttagttcagttctggcatctagtgagtgttcaataaatggtagctacatttatgctgccgagttcagggaaggggaggtcggagagggctaggtggtttcctcatgaagccttgccatgaagaacctaggagcagtagaggcagtgatgaggacagtaggaaaccccactcctgaaagttggtggtgggggacacataagggcctggtggtctccatcaatgcctgggaccctggctgcctctgggggtagctggtggtgccaagttgccccagtctctggcttccttgaatttcaagtcctgtactttgagcatctggggccctaggtaaatctcagccctttgggcctatttccctatctgagggaagtgggtcctaccaccccagttttggcaaagacagacagaaatgactgtcaaatgtgtactttacatggacagaggacccctgggttctgggcatgagtatggggaagaggagcaacttccgaacatgcaggctgtagcttcacccgggccttgaactgcctgcatctcacagaccactgcattgcattagggcctcctgagctggcctgtggccgtgcctgatggggcattcccctctccagctctgcctgcatcagcccctctgtggctcctcacatgtgctctagggatggtctgttccttccaagcacagatggaggatgcccaggcaggtcactctgccttggcagcttcctttgatgcagatcttgaggtttgctcctgcctatgctggcagctggacagctgatcctggatggtgctggctgagctgcatggagttgaagcctccagctctactgatatttagcatcaatacactccttggccagggacagagtttatcaagagtcaggaaaactaattatgagaataataagaataatatcctataattcattatttgtagtgcattactgtttatgaagaattttcctatacacactattgcaaccctcacagcagcgtgttaaggcagggggtgttatcttcagaggagataggctcagagaggtaaaggagtttgctgaaagtctcacagcagggaaattgcatagaggagttttctacctcctgttggctaattctaaccttaacctatagtggttgggggcagatggctttatcattggcattctctgctctgggggagacaagttccctatcctttgctcctttggggagggagtggcttctttatctagcccctcacctggcctgggctcgggacagttattcccactgggcagtccaggtgcaatctgtttttttcctgggagaagacaccgctgctctttttaatattcctggaatctctgaagtgccgaggaaaatgaagcccatttcagttaaattttaaaaaattgttgaagtgctagccatgtgccagggactgttctagacactcagcagtgaacagcacaaattaaagtctctgcctgcatggagtttctattggagtggagaagacatcatatctgagataaagaagtgacatggtttgacatggtggtaagtgctgacgagacaaaaggaagcagggaagagcatatgagatgcggggccggcgcagggttggattttgggcaggaaggccagcgcaggcctccgtgtcttttgagcccatgtgtgctcacaaggtcaggggcactttgccatccctcaatcctgttttgcagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtaagctagcttctccgcggctgcctgtctttgcacaggtgctgttctgtaggaaggagatgagaaaggcctcacccctctgccctggggtcccctgtacttaaagcatcccagaaagagcgcggtttctcctttcctcagtgctttgcgggtttctgcaacagttttccttcataagctggcatagcctttgacttggtactccctgtcccctcttttgtttttgaggcaccatcttgctctgttgcccaggctggggtgcagtggtgcgatcttggttcactgcaacctctgcctcctgggttgaagtgattctcttgcctcagcgtcctgagtagctgggactacaggcacgtgccaccatggctaattttttatatttttagtagagacaggggttttgccatgttgcctaggctggtctcaaactccagagctcaggtagtgcacccaactcagcctcccaaagtgctgagattacaagtgtaagccactgtgaccggcctccctgtcccttctgcgtgcatagtgtggagcctctgcttgctggtagctacctgggtgcctctgaatggctgtcatccctctccccaggcaggacagcagccttgcagagagttaccagcccagagcataactatttggtgaggagtgatgaagacattgcttcaggccttgagttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagaggctgtcctcagccaggtgtgcaagtagtggctgtcccatctgggaggctgtgaggatcctgcctagggagagagactgagtgagatggcctttaaactcccttccgactctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcgactgaactttctggaatccaagttcagccttcatgagatgttaaacgaaatgtccgagttcaaagagttgaagagtaacccccaccgggacttctataacgtgagaaaggtgcgttaggggcgagtgttcacagctgcctcacccggtccccctcccagcccatgggatgccctgagccagtctgaggcttgtcccctgtgagaacttcagggctccttgctaagggcggccttcgtggccagaggggtatgaagcatatgtgcagaaggaagatgggtgagctgcatttgtgtcaggctgggcctcagacagcacttgaatcactctaggtggaaacatttgtccgcattgtatatctgttgggatgtgccctcttccttggaaaatagggcacagcctattaattggtcataaaagttgagcacagcctacttttaaggtaggggatgtattagagtcatcaaagaaagacacagctgttaagatctctttggtcccctccttgtgtccatgtgttctcattgttcagctcccttataagtgagaacatgcggtgtttggttttctcttcctgtgttagtttgctgaggatgatggcttccagctgggcttaatacctaggtgacgggttgataggtgcagcaaaccaccatggcacacgtttacctatgtaacaaacctgcacatcctgcacatgtatcctggaacttaaagcaaaataaataagtgaataaaataaaatttaaattccctgaaaaaaaaaaaagatctctctggagatgggagtttgtggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgaggcacagggtcagtgctaggcagggggtgtttgatggtgagcaagagtcacttcctgtcaaccaggtggctttgagggagaggccagaactgagctgacttagagtgagtaggagcttgccaggcagagggtgtggtaggggaatggaagtggtggcattccaggtagaggcacgtgatgtgcaaatgtcaggagggagggatggtatgagagagtcgagagagtcagaacagtgtgttgacataactgcaagcagtgtggtgtggttggagctcaggcattgggagcggggagcagcgggttgtggggagagtaaggctgcagagatgtggggaggtcctggatcatgcaggggctgtgggtttcccacagaaggcagggaggtgggccggggtgtggtggcgagctgggagagaagctcctgggggaagagtcgggatcaggctttgcttggaggagggatggctaaagctgggtggagtcacagtggggttgccatctccacaggagctctgtcccagctgggaacctcttggggacttcttctttttggggtcagctttgataagggagggtaggccaggggaggatgtggctcctctgggaaagcccagctccagcctccctgaccccctggctgggagcatatcagcaatgcagatggaagaccctacctggaggccctaagaccacttctgttacacgccaggggtccaacacagactcccacttggatgggatcaagagctttaagaagtgagagtttggcttcagctcatgtgccctgagaggcttacagaagtgttttggggatttccaggcagaagtgaaaggtgttttagacaccacttacgtgggcaccctggcattttcaccttcaagcaccatttgttccttctctgtgaggcttaggcgttcagacaggtggatgcctccatcactgtgtgaactcctctcagccctgcccaaagaacttcacacgcctagcacatgcccaggcccgtgttcaaagaaacgccttgcccagcccgatgcagccctgccctgagcatacgtgaatgctctgggcttacctgcttcctgctgcctggggccaaggtgtcctcactggctgtgctggcactgacactgttttcttctaaggtggggccccagtgggtgttcctgggtctaccagctgccctctggccacaacatgagaaacagtcctggcgtggggctagggtaacaaatcagagcctatccccagggttctcctgcagtcttggggttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagttttgctcttgttgcccaggctggagtgcagtggtacaatctcagctcactgcaacctcagcctcctgggttcaagtgattctcctgcctcagcctcccgagtagctgggattataggtgcctggcaccactcctggctaatttttgtatttttagtagagatggggttttgccatattgcccaggctggccccgaactctcagcctcaggtgatctgcctgccttggcctcccaaagtgctgagattacaggcgtgggtcaccacacctggccttgatagcactctcatagcctctactatggggaggagagctgctttctaaaatccagaatgggctggatgatggcctccgtatgtctaaagtggctattggtgtccctggggcagacaagggctgtggtctgaggcaggagctgcgacgtggccgtggatctgtgtgggtggtatctgtgaaggcacctgtcacactacagcaggtgaagggctgagacaccccgaggcccagccagcaggactgtgtgactgagacacttgttttctatgcagaagcaagacagaagagctgagtgtgtttgctgcttgggaattgggtagaagtaggtgacatccactgtggtttaagtgtcatattaagaatagcaaataggttttaccttctgtgccaaacctgaccaattaggggccacccctaaagcttagtgaaaagagtgctgtgttcgattattgatgcctgccatgggtatggaaatggtcaatgttggcttaggtcccaggtctggaaactctgctctttctttacatctgaggtcttaggtgaacacggggaatgcacttggatcctctggtgaactgaaaacactgacctccaatgaccttcaattattttgttcctaaaataatcacccttgagttctgaagtttggatggggtgcttcctggattgtccagttgttttcctcatttatcttgtgactcatgggggtaaggacaggctgacccccctgtggtgtgtcattggtaagccagaggacaggaccagaaagcccagaatccgctgagtcatgctgaggtcattgtaccaagctgtgtccagctgagctgagccaggctgaccttcttttgtgcatcccacgtgagcccagcctcatctctgaggagcctgggctttggggatgttttagttttctgctttgctttgtttccccagtgtccagtggtctgtctttctggtaagaatggcaagattaatggcaggaaggatgctgatgagtgagtgctgtggctaacgacatgggctggctggcataatgctcacagaggtccagtggatcaaatatctggtttggcattacttggagatgctcagccagccgtggacagcattccctgccctgaggtcagccgcctcctcaccccagcccgggctgagcgcccagtcggccgcagcagtagctccagagtgtggtctaatggctgtcagcagcctggccttgaggctgctgtcgtcctcccccggagctcccataggtcccttgtgctcagggagggggagtcagtttacccatagtgacttgaggccatccctcagcttagctggggcttcatttccttagggcttgtggttgtcctatgagtgaagcacagtgaaaaggcagactggggatgaggggttggggagatgggtaggatccaggcaatattagcagagccctcatcctaagattaatgaagagggttcagtaacagaatcaaattacatttaaagaatcccttctagcttctgtgtatggagaatgaattgaaccagagcacaagaaaaaggaacaagaccagttaggaggtcactgtgaattcaggcctgagaacatgcaggcttgaactcccgtggtggcagtgaggttggagaatattgtatggatttgacatccatttggaaggtagaactgatgagactcactgagggaagggagtagtaggaaggccaaggatgactcccagtttttcagcatgaccagctggattcaggacacaccatttcctgggattccagaatctgggagaaaatcaggtttgggctggggtcagagatggagagtccacttttggatatattaaatttgaactgcctttgggttatccagatagagatatcaagaaggcaatagtatgtacagttctggagcttttggctggtggcataaatttgggaattggtataaggaaaataattaaatgcacagaaatggaacagatcacctttggagagaatttatagtgagaggacaagagggcccaggaccaggcatcaagaaattccattattaagaggtctggtagtgaggatgagctgactaaggaggctgaaaaggagaggacagagatgcaaggggtcggtctggtatcacaggacttagcatgatatagagggcatgagaaatcccatgaggtgttttgagaccttgctgggctccttctgcaaaggtgccttctgcaaaaaactgcctttccctggaatgtggggagaagtctaagctgactgttcatttctgcttcttaggatttgctctaagatctttggccttgggccccacagcttgagtccatatgttggcttagggtcagtagagcggcttccagtagagtggcttcttcttgggacttggatgccctggagtttgggtgaggtgtaactagtcaaggaagggtgtgtttggaggcttggcctttagtgtctgttcttttcattcattcccacttggaggtttgctttgggaatgctctgagggttctgagagggatcaatgggaagagtgggatttgatgggccctcagggttatcactaaaactgtgagaacctgtcgtacctgttaatttgttcattcattcatccattggttcgactttgtactaggctctggggtaggtgctgaagacttagaggcatcaaacatggcccttgtccttgaggagctcccagtctagtgaaagcgtagacacacaaacgttagagtgatcgggacggtctgcacaacaatgggatgcctgtgccaggttttgaggttgggcaagggaaagagcattcagttgtgcttggaggaacaaggttggctcccaaatggaggaggttgtgggaaatttctaggtggatgagatggtggagagaaaggagggcattccagactgaagaaacacgtgggcaaagggatgcagtgtactgtaccttggtgtgtggtgtacccgtaagtggtttgtcacggctgcagcacagaatggggcagtggcaaggcgagagttaaggcttgaaataagccttgaatctcaggccaaggtgcttgggctttatcttgagactgatgggcccataggtcatttgttaactggggaatggcctgatccaatctgcattttaaaaagatttcctggtgctgtaaggaggtggaatgcgcagcaaggctgaaagggagggataccagttccgaagtctggaggagaaatggggggtgggatccagacactggtggggctgcccggatggcccatgaggtgctggggttctgtgcacattgagggttggatgtcttaactcttgttgctaggggaggtggcctgactcagggcctggtgggcgctgtgttccaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttaggagttttgtgcccttaggcaactcacagaagcctttatttccttgcctataaaatggtgacagccatgtgccttattaacttaaaaaaatattaaaacactaaatgatggtgtaactgctatggaaaacagtatggtagttcctaaaaaagttaagtatagaattacctatgcctcagcaattcatttctaggtatatacccaaaagaactgaaagcaggaacttgaacagatactcacataccaatgttcatagcagtattattcatagcagccaacagatagaaacagccggtgttcatcaacagatgaatgggtaaacaaaatgtggtatatccatacaacggaatatcattcagccataaaagggagtcaagtactgtacatgcaacaaccatgaatggatttttcaaaagattatactaaatcgaagccagacacaaaaggacaaatatcatatgattccactgatataaggtccctagaataggcaaattcatagaaacagaaaggagagtagaagctaccaggggctggggagaggaaggtatgggaagttagtgtttagtgggtatagagtttgtttgggatgataaaaaagttctggaaatggttagtggtgatggttgcacaacaatgtcaatgtacttaaagccactggaactgtatggttaaaaatggttgaaatggtaaacgttgtgttgtacatgctttattagaacaaaaaaaacttttgttaaacaaaacattgaatgatataatgtggagaaagtgctttacaaaatgtgagtagtgatagggaatgttctattattcagtggtgcagcctctctgctcactaagtcagccatgtcctgagccgagctgtggtaacttgcaggtggggcctctgctgttccttcacagggggccttgccaaaggatcccaagctgaccgagtgaggatccatggtcctggtgctcaggagtttctaaggtttcatgcaagaattgacatagaagatgtctttcggtgtggccatacagaaggccgcctcgtaaaggtctagagaggggaacgtgcatggtggctgcagaacgatgcgttgattggtgtggtctcccccctcagggccggcagacattccaccgctttgacaagttcaactccaaatacaaccctgtgggggccagtgagctgcgtgacctgtatttgaaaactgaaaactatctgggaggagagtactttgctcggatggtcaaggtgagtgaaccctcagtctctctgaggcctctcaggtgcctcccaacatctgccttcagagagtgggggccctgtgtgcccctggccccttcccctccctctgtgtaccatcagctcagggaagggtgaggtgcccaggtgcccagtgctgtggtctggctgcctgctccaggcagtgctgcatgtgccaactgcaggaaagaggagggaagggtatccaccttggccaagctcacagcacctggcctggctttcgtgtctctgcagcctgaacctagctgggtgcagatgagctccgtgtggagatgcttctgctgtggcctggttctgcagacccaaggccttcctcaccagagggggcctctcctaaagtggaacaagagcttacaggagcaggcagccctggggatttagatgagtgcttccagcctgggagcaaggtggctgggggagcaacaggaccctgctggtgacggagagtgagagtctcccatgtagctgggatgcactggggctgacccaagctcttcttgtgccaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttagtaagtgaggtggcccgctgtctaccctgtgccctacagaggtgacaatctgtccctcatgggctgctgagtctgcactcctgaggggtagggcctgttctggtgccagcttacgcttgtcctttccagggatttttccatagaaggagtgatgaaaaagatgtctgcatgacactagagctcttttttttttttttttttgagacagagtctcactctgtcacccaggctctgagtgcagtggcatgatcttggctcactgcaacctccacctccctgattcaagcaattctttgcctcagcctcccgagtagctgggattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggttcctgccaggtggggctggaaaggctggatctagcccccggcagcaccaagcagcagcctcaggtttttttttcggaaatgcaaacacttcaattcacctgctttacctcgcaacagaggccctcacaccatgtgtgattaagtacaagcccctaaagtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgagggctggggcacggggaaagaattgagtctgtgtgcccagaaagtgactggacaagctgagggacatcatcaaatttatgttttagacaaacatattctggctgttgtgtggagttggcccagaagagaaggtagctggaggtgggggcaggggtgagagtcaggggcctgcctggagacaggaggggagcttgacccagcggaaatagctcacactcgtgcgtgcttctgcctggcctggtcagacgccacaacgtgatctcacctaagcctcacaattaccccgttactatcaccattttgttgttaacagtaagcggaattattatgtgcttggtgcgtgttggacacggtgttgagtgctctccctggattatctcatttaatcctcaccaaagccctgtgaagctgctagcttcaattgacacacaaggaaattaaaacagatcataaagctaaaagtggcagagctggaatgcgtttccaggcaggctgactccagcgatgtaccctgaacccctattctatgttgcctcccaagtgagaatagtaaggtgcacagcagctaccagcttgcgtctctgaggtgtggcagcgcagggactctgcacaaagtgtggggcttggtgagaagcggtgggcgtacacctggcaggacctggacagagactgaaggaggcactggggggagtctaggatgcctcccaggtgcctggctttgcaggagcatggatgatgtgctgtccgaaggttgctgccagcaatggaggaagagcaggtatggggaggaggaggaagagcaggaggaggagacaacgcattttgcacccgaggctgtgggagatgcagtggtgaggccctgcttcagctggatagagctctgaagaggggctgaaattatccgcatgccaggccccagaaagttcgggtgaagtatggagctagtgagcacagagcagagctcaaggtcctccctggccccccaaacccgtctagggagtgcttagggtcatagcagggaccctgtcatttcctttgacacacagggctctgtgacacggaagattctggccaagctgccttgctcctctgggcctttgctgcccccataggaacaggagaggccagcagacctggctggggtctggggcgtgggctgggagccctccagtttgggccagttgtggattaagggggacagtctctttctcccatctgctattcagaggcccctttgcaaagcactgccgtggcctggtagcaagcctcccctgtgcgctgagagcccgtaccctccatgcatgtgttcttggttggggatgacccctgggatcagccagaaggctccagtgactcaggagcagccccccaggggtcccagccaaggtagaactgcagtggaagggtgggggtttcctgaggctactcaggcccatctcagagggcagctcccagtggggattggagagcagagctgcctcccaggagccatggcttagcccagcaaggaccctcttatctgtctgtgaggcagctggcgggtttctcctggccacacctggacatgccctagagtattctctacctaccgccccaaagagtgcagacccagagcccagaacctgttttttttgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccctcctgggttgctctgaatatgaattaactgacgtgagtaaagtgctttgagcagggcttgatgagtgatgtgtactaggacccttttccctcatcgcttgtcgctgctgctgatggcaatggccactcctccctgcaggctggcctcggcatagcagaggggcaggtggtggccatggctgctttgcccttcacctggcttggcagtttcctccactgtcaccaccaccacacaggggcttggcactctcctgtctcacctccagagtacctatggaagctccgaaggggcagaccttggtgttgtacccacttttcatccctgggaggaatatggcctcaggcaggccaaggggtccccagctgaggtgtgaacctgaggggcccagacccacaggcctctggcagctatgagctctgggaggctgaaccgaggctgagtcctggtcctgccttggcctggtgctcaggacctctcctgcccaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatgcatgtccatgtgcccacacacctcaaaacacacagcactttccagcctgctatatgaggcatgtctccacatgatcacacacatgcaaacatgcccaccataacacacatgccagtacagacatatgtcatgtacagtatgcaatgcagccacagtccacacgtgtccacacatttatatgtacacacaccagggcacactccacgtgtacctgtacatccctgagataatggaagcataggacatgctatcacacatgcacggtcacttactgccacaccaacaatgtccacacgtgcatattttcgttcagcaaatcactgcatctggcatgcgataggcattgccctgggcactggacaaataacggggaacaaaacagactaaatccatgcatgcccttacaggcagaggctcctaccaatacgcacacagacgaggcacacgtggccaggagttagctgcccagggcagcaggacactgagccattcccttccctacaagtcttgcatcccactttcccctgctgggccctggggtctctctagctcagcctaaactggtgctagttggtgggtgtggaggtttcgaatggggtcctgattgaaagaaatggcctggcagggtggaggcagtcctgggctgagcttttggagatgggggctctggttctggctttgctactgacctgttcagtggcatggaacatagacttcactctccgggccttggtttgcccatttccataacacagaggtcagactctgtggtttctcatggccttccctgctctggagttctacgaatgcgggacacaaggccaggagaggaattcaggagagtggctggagggcacagcagggtctctttctactgcgaggcccactctctgcccgtagaggtgatgcttcttggttctaaggggccccagggcctggacctctgcattttaggaggggtagtttccagggtgcactgggtcagcacagctgaccatgggtggtcattccccccggagctggccctgagctgtggctgcaggccccaggcagagccaactggggggggccttcctgattcggaaaccccttctcttacagggagcgcggcctgagcacgttcctgttccggccgcactgtggggaagccggctccatcacccacctggtgtctgccttcctcactgctgacaacatttcccacgggctgctcctcaagaaggtaaccaggtcactctcgggagcccgtcctgagtgactgccctgccctgggctcctgggaggctcaaccagtgaggccagaaggctgggccctcttctgggctgggatgtctgtccttatcttggttttatttttaattatgaaagtaatataatcaaactcatcacaattttgattttccaaaaactggagaaatggaaaaaagccagcccttatgctattacattaatagaaatagccattattagctttttagtatatctaatttccatcttttatccacagcatatttttaatgtgtttattatcataatgaacacagaatttggttcctgcctcgtcccttactgttgtatgacaagcattttttgatgctgcaacgtaatatctatgctcctttttccaaaggctgttgttggatgaagggtctgccactttgtctgtaattgactcaaccagtccacactagttgggcacagagtccatccaccttttcactggtgtacccttgagctctgtgcatacagtcttctccgtattttggatcactttccattggcacgatgtttgatcaaaatgctccctttccctgatcccggtgaggtgtaaccatgggtcacatttttgggtggggtgggtgctacagtagaaaaccactctatcctgggcaggtccacccctcccatcccttcagggatcatctcccaggagctggagtgtttatagtctcaacctggctgtttgcagtcaaagcaataaaacagctagaggggggcatcttctagactgggtccgtgcctaggagaaaggagctgaaggtgtaggctggagtgggctgcccttcctgccctgagccttgcctccagtttggagcaagaatgagcacttccaacagtgggtagaggcaccagggagggctggcatgcaatgtaggaatgagatgaacagtggggaaggggagagtgggtctgagtgtcctggcttcgaggaactcgggttgaggacttgggcagacatggttcagacccctggtttccactggtgaatgcttcttcccttcctttctcccttcccttttcccttctcccctctctggcacttgtcacatgagttcggtggttcttttgcagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggtaaggactttggggtgaggacagtagtgcttcagtaggcaccagtcctagcctgtcctcccatttcaggaacctgagcccatggcttagttctgcttttggggtggggttggtggcccagtgaaggcaggaaggaagccactgttgggggaaaattgtgccatccaggagccctttctttggggttcttgaaccctcaaaggcacaatttagtatctttgccttcctctattttctctttctttgacatttatgagctctgtgaccttggtaaagttattagatttctggatcaagttcttcttcatctgtaaaatggagataaaattttctctgtccctaccctgtaaggattcatgaagataatgaatcaaaggttctaacatagtgtctgcatatattcaaaatggttgctactttttaaatcaatgctattataatttctacactttgggtctctgggaaaataaaagaggaagctaacagtggtgtcatgcatggggactagccgcaagtatacccagcatgttttgatggtgtcgacaagaccagccattgcttaacaaaaacagaagcaccagagtcttttaggacagaggttctccaacctcttggtctctggacccctttatactcttaagaattgaagctttcaaagacctgttgtttatgtgggttatatctactgatatttaccatgttagaaatgaataagaaattttaaaatatttattatctcatttaaaaaccacatcaataaaccaatgaaatgttacataataatgattttttttctgaaaagtaacagtttcccctgcctttgttttgcatttttaagcctctttaatgtcttaatggaagtcagcaggactcttctagccacttctgcattcaatttgtttttaatcaaaatatgtaaaaatagaaatcttgcctcatgaaaatacataattggaaaagacaagacctttcaaaaggtcttaggaccctcaggggtccttgacctgtacttcgagaactattgctctaggctacagcggcagtggggtggggaagaggtcacagacggcttgtgatgaatagacacttcacatcccagaagggaagcaaaaccacagctcaaacccagatcattctgggattacaccattttaccacttatcctatgatcacttctcattttttttttgatgttccatctctgcttttagtactttactcatctatctatctatctatctatctatctatctatttatctatctatcatctatctatctattgcaaacttaagaaaatagtgtgttaaaaagaaaagctagagggcaagtgctaaatgtggcatgactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggtatggagtgtgacggtgctgcctgtgtccctcctgggaaggctgcctgctgtgtgccaggagccttccaggcactggggatctgtgatgaacatagcaggcagggcctctgagacactcaggcacagggagagaagacgcggcagcctcctgtgttttcatggctgcttcctcacccttctcagacctctacgcctccttggagaggccttccctgatcgcccattctaaaatagccacacacttgctattattctctatccccttaatcagtttttctccataccatttattcctgctgatgtttagttatgtgtttttctgtctttccctctagcatgtaagctctgtgagggcagaggtttgttcagaattatatccccgggccctagatagtccctggcacatagcaggcgctcaatatttcttgaatagatgaacagtatctagactgaataaaaatctagactatgggactcagacatctgtcattttttaaaaagcctgatgaggagctggcactgagacccatgttctgatgtacgttaggtcccccgacacctccctgggtgatgtcactggttgggaagaggttgcattaggggctgtgctcgtcggatgatgatgcagcagagttaaaggcttaagattcttttcatgcgcagtgtggtgccttggattggccctccccaggaacattgtccttgtcagctctcaggggcttcttaattagagtcttacctccttcccctttgcctttcccatccccagcagctgctgcagaccttatctttcctctctgatcaaggaaagcacagccaggaatgaagggctgtctgaggatgactgaggttgtcagggtgacatccttgaggacacagaggccagcaggaattttaagagttctgtggggataagatgtcctgaccaaagatctgcttcagggggactagtctgacttgctgtgactgatgtcaaagctgcccacatggctatagaaagtgaatcaaaagtatatagtttcatttgtatttctcttggtccacaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 943 - DNA, 10953 bp, Homo sapiens
gaagttttctaaatgctttaattttttgtcacaaatatttctgcatctctcagtcccttcttgttggaaaaaggagggctagtgatacatttgttaatggcacttttaaaatgtgctttggtatatagaggtaacaatgtacttcttaggtatgttaataataaattaaggttataatggttgccatattagagaaaatgaataagattagtctcagcaaaaataaaaattagtttggaagtagataagctagaaatatcaaaactgaaaaaaatagcttcccagatagcgttctactatgtgcaattttttgaggaataatattcaattacagagtgtaataccttgcacagcacttgacatatagtagctattcagcaaatgtttgttgaattttattactttttaaacaaattactgagtaatcttccttagtaatcatttctgtaactcagataaaaatagaaatttataagagtttttatttttgttacttgtaaaagtatatttcctagagaaaatatcagcagtggtagagaccagaaaaagtaagtgtgtgtgttctaaacagtgattccaactcaatgtgttcagagaaaacactttgaccctgtctgtgtttacagtccctgctgacagtgtactgtcgtatcctcagccttgttctatttctttattttagctttacagagattaggtctcaagttatgagaatctccatggctttcaggggctaaacttttctgccattcttttgctcttaccgggctcagaaggacatgtcaggtgggatacgtgtttctctttcagagctgaagaaagggtctgagctgcggaatcagtagagaaagccttggtctcagtgactccttggctttcaacccacctagcctcagacagccaggaggcctttttaccactggatactgatgagatgttttaggtccttgcactttgcaaaactcctttctcccagtgggatattattaggacatagccaggctagaaaggccgtgggaagctttggaggtaggaggataggatccagacagggttacaataaggagaagggcattctctttggtgcactccatagtccaatggcagtcctgagctgattccagttaggaaccaagggtggactttcttctttggttctttggcccttttgatttccccagctggggcagggtaaggagcatgaaagaaaccagcctcaggtgtgtctcctcatttctgtctcatctaaacttcagcttccaggcatcgcacggtagttttgcttggactcttggactcttctgggtttttatcagttttctttgattcctcattagggttgctatcattggccttctcctcctttactactttggtttcgatcatttccttctgctgattcttgtttgtaaaagggaaggccttcacatacctttaggcagaaacatgaaattaaagtgagagactctcacacataacgatagataacactttttggccatggtacatattggcacagtacactggatacctttatttcagagtgatgccagcacatgcatgctctaatacattaagacatcaccaccttaatggattcatttaaattggacaatatgtttgcaggccagactttaggctgaccacataactcttccaacaaaaacaaagaaccaaaaatcaaataaagcatataaattttccccagatgtcaattttttttaatttcttgattttcaaaggacagtcattgactgatggctggacgacatgcatgtcctgaaatagaaaagattgggctgaagggaaagagatgagatgagggagaaatttatatcagaggactgctatctccattttgatcagcaaaatgccaacagtgaccctgaaaaagcacaggatagaaacatgacaaagattacaagactagcagtgcaccaacaaccctaccttttgacatagcaaaatccaagaccagctgcagcaccaaagaagaggagagcaagcactagcagagccgtggggacacctgcaaggaacagagacaaggcctgttggtccttcacttaaacattgtgtgtaatgctcattgcatgatccaggtgattgagacagtagacagtacaggagaaaaaccttctctgtagccctttatgatattgggcccacaccagcttctttgcttcatgcttgtagaatcattggccttgcttctcacactctcaattctatcagttgcaatatgacagagttcatttctcctccatggccttgagacctactctagtcaacaagcctgcctgagaaagagatgactagaataaagtcataggcctttagggtatatattttaaaaagaacttatgcataggaacagatagtgatttatttttaaaagtcttgagttttcaacagtgaaattcttttatacttacactttttagcttaatcactaaggttctttacagctctcagattctatgacttcatgaaagttgagtttgtgttaagcttttattagtatttgacaggtcctgagcgcctcatctaaagacaggcaggattctatgaattatctgttatacatgaacatacatacacacgtaacatagacacagaaaccatttacctccaaacccagcagcttcattcttgaatgctgctttattttcaacaaatggttcagtttctgtagacatggtgctagtttccataaaaacttctgtgacacaaatcaatttttttctccgtggaatagaagtggaagctggagcaggaggagtagtagtaggggcaggtattgtagagtaaggggatgccaccgagtaggtactgtcactgacaataaattctgttgtttgtgttgcagtttgagtgttgaatatgggatctttggtggtgataatttctggaatgcacgagttagtccaagtatctgttgggatagggaaacatggaataaaagtattgcaacagcctcctaactgttcttcttgcctctagtcttactacctccaaaccccttataccgcagctggaatggtctttaaaaagcaaatctaaccatatcactttcttccttagaagccttcagtggctatctttgttgtatggcctacaaggccttctgtgatttggcccctgctaacatgccagcctcatctgctctttttctctcattgcccctgccatactgaaattacttgaaattccttgatacactttatcttacatccaagccttgcaccacgatgctttattcacctttatgactctttgcctctctttatttagcttactctgactcatccctcaggtctcagattgaccctgtctttctcaggcagacttgttgacttgattggcatatgttcttgtacttccttgtcacagttctcattacactgttccccactggactgcaagctctctggcagcagaaaccccgtctgtcttggtcagcatggtatgagcactgtgtgtggtacatagcacatgctcaataactatttgatgaatagggaaggaaggaaaagggaaaggaaggaaagtatagattggaagaccaaatatacacatgtggtgtcacttcaggacaaagatatgctaagacctgatatttctgggctcattaaaaaaagaagtgaacaaaaagggaccaggagagggataagggtttgctttccaatctgttgcatgtgctagagaggaaacacttgttaaagcatcttaatctgagttgaccatggcagtaagtgtttaaataggtatctcattgaacaatattactaaacccttgtttacacaggaggaaactgaagtttagagaaattgaataactcgcccaaagtcacagagctagtaaatggcagagccatgcaatatattataatataaatttgcatctattttaagtccctaattatttgtggcagtgggtagcatcagctggggttggggggtgggctagcagagggatagcattagaagaaatacctaacgtaggtgacgggttgatgggtgcagcaaaccaccatggcacatgtatacctatgtaacaaacctgcacattttgcacgtgtatcccagaacttaaagtataataaaaataaaataataaaataaaattatctctggaaaaaaagaaaagaaatacatgggatgggagtacaagttaaatgaaaccatgaggaaatagacaaatccaagtcctcttcctctggctcttctctgtttagtcagagggctgggtatcatcacattgccagctggcaggaaggcagttaaaaagcaaagccatttgacaggcatgggctggctatgaggtatgcaggcatatgtagctcaccaattccccagccagtgatgatagaccaaagaggcagagaagggaaggaagatgggaaatacactgttaggagaagccctatgtttcagtcttgattctgccactaactgaccgtaggaccttgaacaagctaagcccgtgttctgaactgtagttgtttcatccatgaagtgagggaactggtcaaagtttctccatgggccttttctgtgccaaagccctctggatcagggaactacttggatcctatattgcctttctgggacagtttttgctaatattggctggtgcacatttatctctcggatcttcgagaatgatcttgaaatctatcctgtgtatgacctctcagccacctaaccttcagaaggtcagatagatgagtatgtgtgaaaagtaataatcagacaggggtccttatgacaaactgagagcaagtgagtatttagtaaaagaaaaactttaggagaagtacttaggtgaagcacttgggctaaggcagccaaggtcttcaagcaaggttagtgggtgacttcatgaccacgaacaaatcagtgctgccctccaggtgtcaatcttttccttcataaagtggagactgggtctggttcttaaaattataaaggaatgtggaacagtggaaagagtgcggtttcagagttagacctgagtctgaacctttacagtaatgagacgttagacaaatgtgtttacatcctttgaactcggtttctttttttttttttttttttttttttgagacggagtctcactctgtcgcccaggctggagtgcaatggcatgatcttggctcactgcaagctccgcctcctgggttcatgccattctcctgcctcagcctcccgagtagctgggactacaggtgcctgccaccacgcctggctaattttttgtatttttagtagagacggggtttcaccgtgttaggatggtctcaatctcctgaccttgtgatctgcccgcctcggcctcccaaagtgctgggattacaggcatgagccactgtgcccggcctgaactcggtttctttatttgcaaagtggggatgataaagcatatctcatagggatctgtagattccatataggtggaagcaaccaaccttggattgaaaatatttgggaaaaaaagaaaaataacaatacaacaataaaaaagcaaataatacagtacaatgactgtttacatagcatctacattgtattaggtattataagtagtttagagatgatttaaagtgtacaggaggatgtgtgtaggttatatgcaaatatgaccccattttatatcagggacttgggcatctgtagatttttgtatatgatggggtgccggaaccaatctcccactgacactgagggacgactgtgcatcactttgtccataatggatgcattacatacatctgtacctttgttccttcccttctgcctgcttatcttataggatgcagggatggtggcagtggtaattgagcctcctgaatgtcttctcgtgtgttgccattcagttatatctctcctaactttttcctttgaggggcatattgccacccctagcctggccagagagacagtgtcgggagaattagatggccgtggctgtgattgcttctgctgctgctcagggttactcttcccagacaggtctcagagtgagagatacccagagaatgccacgtggaaaggttgcagatcagactcaccagatgagttgtaacaataggctgcaaactgtcggctcactggaaccttccaaatcaggacacccaccccatttttcccacacttggggtttgggctaatcctagagatgaccacgaatccatctccaacccagccatagctgtaaaagaatacacactagttgaacagaaaaatgattagaaggcttcatctctattgctgaacaagaacacagagctaaaaaagaactccagcagtgacagtgaaaccagctttttctcacctgcaagtttcaaagctagctttcaaggctgtttcaacttggtccttgccggccaaacttagtcccagcagcctacaggcctccttagcttctgtgaaattcagctgctggttcgcctttttgctcacaagggtgatccccataattctgcatgacacctggatggaaagctctgcaaaggaatcacataggtcctcagtttgctgctgtccttgtttccagcccttagactctccttcccagcagagtatatcgtcctgatgcgcagggaggtctatctggctgggactggggtttagaataacaggacacagaccaggcattttccacaaggaccatctgctgggctagatggatgcttgttcttgtccaagctgtaaatgtcgcccaatcaaaatctatcccatcccactgcattaagatgccttgctcaccatataggggctttggctacctgttgttggggtgcagtctaagggatgcagttactgcaaacctttctggagtctgtaaaatgaagcatctgagactttgagaaagatagaattcagggctctagttcatagaatagttagcaataccccaaaccaatgtggtttggggacactactatttgtgagatgggctgaaaatgtcacacttgttataaaagaatgtgagtgctctcagttccaggtcttttggccactgggggacaggcttactcagaagttcctggaggagctggcagtaaactttgaatggcagaaaaactaaatgaagaaagcagaattttagagtcagacttgggcttagatctagcatatgtcatttgctagctctgtgaccttagcctagatacttcatctctttaatcttcagctctttgagcctccttgtttataaattcaagggagtaacagtgtctactgaatagggtagtgaaagttaagtgagtaaattctaatacaaatgtttagcatagtgcctgccacatggtaggtgcttaataaatccacataacattatcattatcgttaaagcattttggttttggtctgctaatgattgattaccccacagaagctgaggctgttgaataggtaagatatgaataatatttctactcaaaatctaatggatttgggaattcttttgaacccttttctctgggttctgggatgtacagacctgtataaaattgccaagttgtattgtattcaaatacattattcctactgggcttcatccacaaacatccataaaagggcatttaaatctctcaagtaattgcttgtacgcagctctgtgtattggatgctcagtcaaatgctttgaccacttcctaggttgatatctaatggaagtttctttttgaaaacatggaaggagcatttctaagtcctccatatgaaccttgctgtggtggcagattaggagcacacactcaattatgcctgattctaaaaccccagttcctcttttttccttcttctttcccaagagatggatcttgctatgttgcccaggctggtcgtaaattcctgggctcaagcaatcctcccacctcagcctccctgagtagctggaactacaggtgtgcaccagtatggccaagcaagaaccccagttctttttttttttttgagacggagtttcactcttgttgcccaggctggagtgcaatagcgtgatctcggctcactgtaacctccacctcctgggttcaagcgattctcctgcctcattctcccaagtagctgggattacaggcatgtgccaccaaacctggctaattttgtacttttagtagagacagggtttctccatgttggtcaggttggtcttgaactgccgacctcaggtgatccacccaccttggcttcccaaagtgctgggattacaggcgtgagccactgtgcctggcccttttttttttcttttttgagacagagtctcgttctgtcacccaggctgcagtgcagtggcgtgatccatgctcactgcaacctctgcctcccgggtccaagcaactcttgtgcttcagcctcctgactagctgggactacagacgcgagacaccatgcccagctaatttttgtattttttgtagagatggggtttcaccatgttggccaggctggtctcaaactcctgacctcaggtgatccacccacctcggcctcctaaagtgctgagattacagtcatgaaccaccgtgcccaacccggcccccagttcttaacaatgacactgttttacctttcacagtgctataaggaaatgaacacacacagacacacacacacccctaggctgaactccctgaacacaccgtttgctctgaaatttggctcttttagctcatgagcttgctattgctcaggtctcttatagctacttctttgggaatggattgcagaggtttatttgtcacattatcaattggtcttactaccctctcatcatatgtcatttgtactctaaatactattatttagaggagtgatagacttattctaggtggatagacttagctttgaatattttttctattgttaactggctgttgcgacatcaggcaagtcagcattctcatctgaaaatggggatggatatatcttcttcacatgatttttatcagaattaaattagataacttgtacctagcagaggcggggcccagtaggaagtcaacaacattagtcattttatgctttcctatttcatttagggatcaaaagagggagctggaatttaagggagtactccagtaactccttccttaagatttctcaggaaacagcaaacatagtagaaatagtgtatgcttaggagttagatataaggatgtggaatcagataatagcatatgcttaggaatcagatagggctgaattcaaacccaatatttattatgtactgcctgcatgacattgggcaagtcacttcacctataaactgtctttttgagaggattaaatgaaattgtatatacacacctagctctggatcactatatacttggccctcaaatatagttcccacccctattcacttaccttcatcaactactttattctgcagtcatggttatgctgacttttggttgtttccaaaaatgtaatttccctagaaaatctttttcccttgctgaggatagtccagagtgtgatggagtcattttcaaaaaacagtgtccaatagtttgaataatggcagcattgtggggaaaaatagtctccccagaggatttcaaagaggaccaaacttatttgaaagtaacagtattttaaaaaactaatcatataactctgacctttcttataaaatgtaatgcaacaacatataaatcaactctgaatgtctgtttctagcatattttatatctcaggtcatcttccagcataggaacacacattttcctattaaagtgctcagattttcatttgcccagagctgcaatgagtgatttgtggttacaatttttttgcctacagtgcaaaatgaggtttccatttaggcatctcaaaagcccagcgatcactttaagtcattcctttagtagacagccgatggcttaattttcaaacttatatttttacagatttttttcagctaatttgctatttactgaatatttttttaaaacattgcacctcattcatggtatgataaaatcaaaattaaaataattatgctaacactcccaaaaaacataaaaacaggccaattttagtgaaagttacccattattcccaagcttagtgattgctttaaattttttacaatcatggtttgcgtcttcaatgaaatacttaaaaaaaaattattacttctggatgcagtggctcatgcctgcaatcccagtactttggtaggctgaggcaggacgatcacttgaagccaggagttcaagaccaggctgggcaacaaagcgagatcccattgctacaaaaaatttaaataccacccatacaaaaaagagtaaaaatcaaatggtttctcttcagtgttttatttcaaaatgtcctcattaaaaatattccataaccaaaagtaaaagtccagatgatacaaacgtaaatgtcaatcattttggtgaagttgacaatatggtggtacatttttggcagagcagtaccaccaattagacctgctgttgacactgagggtcaccctcattcccagaaatccatagtcaacagcttaggaggcttaggactgaagccttgcttcagtttggaaatctggtgagaaacctaccttctgcacgcaaagagccttggaccaggagcctcgtggtccagatggaagtgagaagcaacaccaggctgaagcacctggccatcgtgcctaccccttcagagccagggaaacacctcagatggccactggtgatatgagaggcagatgctcaataactagtccggatggagagttctggaactatgttgaggctcacactcactgctccacttcataaccgagacatccggatttccctgctttcaagcttctgacttgtcaaggtcactgggggaaatgaatgacgtcccttgaacgcccaggctgtactttgtggatggccttctggaaaatttagctaatgctgactcagaaaacacacaaatgag

SEQ ID NO: 944 - DNA, 79211 bp, Homo sapiens
gaggtttggaaatgtgcttttattttcaaactcaggtatgtgacactctacagttcaatgctagcacacctgtgtgaggcttaacaacatgaggaactgatagccagtgatacacaaatccagcacttcctctccatttactctgtcaggctgtatatggggagcaacacatatggctttgtggcagccagaaagtgaaggtctttttaggaggtgacatcaacaatgacacaaacacatcactctgcaactgaaggcagggaaccagactcctagggctaagcagagatgtcagacttcagaggcatttgggggactcttcagatccacatcctcactgaaaatccagggcctgtttctctccagttcactaccgcttgggcagcagctcccactgcttcaggctggtctttgctttccagaaaagatggactcatgagcactttttcagcccctgtatatatggctattcttatgctcccttttggagatgtccttttcctcgacctcccttgcttacaaatggaatagggtgggagagggcctgtgcctggaagtactcttgcaggcttttctgtggggcagctggaggtgcaggagctctccataactgccttcctggcctttgactcatccagaaacaaaggtaggaaacttgtgaccaagtgaacaatggggccagctgagcctggccctgctttaagggaggcagagattgaacattccccacctggagttctgcttccacggccactctctagaactctatttgcatcctgtctttggctctgagggcctcatgtagctaaagctccttcagttgtatccagaccccctggaagaggccgggcaaatcatccacttctgcccccagagtccctctgccctgctctgtaactctttaccttaatggcacatccttgatcaaccctggcttgggcctcagtcattttctagctactgtaaaggatgcccccttcaataaacatgctattttaaagtggggcatgcttggggtggggggtctctctgaaggagtgactgcattgagcccagtccttgagcttggcaatggtgttgctagtctggtctcattcctgctctctcacagagtagactgaaaaacagaataagctgaggttaagaaagatgttgctttttgcattgtgatggtgctggtactgagaagcatgcagcatgtcagctgtccccaggctgctctccaccaccttaaatgtttgcttgttcttttgagcaacatttaatgacaccctcccaagcgtcagccaccatgctaggcacttacccaagagatgggtaagacatggttcttgtctttgaggaaaaatgctaggggagatggatacataaataggccatggtatactataggtaaaggtcaataataataatgtttaaaacgtgccagaaagcacagaggagtgtgtgacctattatgttgtgtctggtgaggagtatggaaggaaggtcatcaaagctggtatggaggggataatttttgcactcggtcgagaagagtgacctgaagaaaagagaagaacagctggaaaaaaaactagtgagtggaggtccagcactatgagagaaactgtttagttggggagccagagatggagtagctgatgggccacttgggggaatgagactgaaatgtgaggcttccagctaggagaccatcagaagagtcaaggagagcacagctctggagccagcctaccctggggttgagctccagccccatgatttactaccggggtgtccttgtcaagttacttgttctttttgtgcttcagtttccttatttgaaaatgggaagggtaatatccacttcgtatttttttttctttttcttcaggacttaaatgaattcatacctatgtaatactgagaacagtgcttggctcatagtaagtcgtatatgagttttagcaatgaaagcaaacaatatcaataacaaaacaaaaatgcaaaacaatgacaacaaaacccacatggaaatcaaacctctacaaaactgatgaaggcagtggctgtaaaagtggggagagaagtcaaaatggagaggggatgtgctccttcagtgttgtgctaaataactggggatgctctgaaacacccctaattatactggggttggaaaccccatttgaactgaagcactgaggtgcaagtttactcttgcatgtggtcacacacagagtaagagactgaagcagaaagcacatcttctctcctcattcacctgtgaggtgggttaactgttttcaaagagagaatagggaatagattgtgctgtacagcagctcagagttggcatttgaaatggagactagtaagtctgccattgaagccatgagttttctgtgtttttaaaacatcttcaatccatgtggacagctcattgaacaggtgcctggtgactgccccacactggtgaaaatctgtgggttggcttggcatgcatcttatttatccagaggtacacacccagagcacacttttgaagggttgttggctctgtgcacaggcatgttgtgtgtgtgtacacaacagtatgtgtgtatgtgtggacagatgcgtatataataattcatatcttcccatttcaagcactgagctaaattcagcctatacttttttttttttttctgagaagcctttcctacttctgtaaaaagaaactctcattccaaaggaaagaatgggaggctgaagttattgaaaatgagatgggaaatgggaagatagtcactttgcaactccaaattccaggtctgatgcttagggtgttagtcattaagcaaattcttcctgataaccaattacagagaggaaaaaagagagtaagttttttactgccccctacctcctcctcccccgtgccccgctccttacccccaaccaccagtgaaggtgttttagttctccccagccacctgagctaggggcaggagaccttcccttccaatagagttccttggtgaaggtgacttcttcatccactggatgctttcccagggcagttttgttgatcctccaagaacatcaagtcactgtgtatgaatagctcccacagaagtgccgagtgttaaaagaacccttcctcatgacctgatgggatgggcggcagtgtgtccacacttgggcctgacgttatacttggggaaagggtggtagtctgagtgtctcagagcagggcactggctaggtgtgaggtttcctactgctctgtaggctgctcatgctggagtcctgagctccaccaggagtccctctgggctgccgagcaagtggatcttccaaggggcccatcagcctgctctgcacaagagttataggaattgtagagccccagcacaacagtcaagaccagcatcactgcagccatcatccagatcacttgccagtgctgacacagtttgggatacatgacttgtaagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttatctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctcaagagttcacttcaaaccatccaagagcaggcagaagattagaagcctctagcaatgtctgggtggtttgttcatgatgttatctcaacctcattaatatttattctctaatttctccctcttcctcctcttcttccttcactctctccacacttctttctctatccctttcatctctctcttcctctccatttttgccccttttccctcttgattccttcccaactgtctttcattttgtcctctctctctctctgtggtgtggtaaaaagacaccgggcagatggcctgctttgacaagttcattctagagctctctgaagaagccctgagccccttcattaagccaggatttcctgatgtttttaacctctaacccaatttaaaaaataatatgaaaaatgagaatactgaggattcctgaaccaaggaggtggggaaagtgatagaagtgctttctgaagatcctgaggctcatacacacacagcaatgaccaagccattggctgagaagcggagagctcaaattttgaggtagcagaaaatgcatgactaacaaaggattgacagactcaataaatgccctccttagaaagggaccagatgctcagaatgcctgccttggatgctagggccacagagaacattgacaggtttccgttccatgcgggaaccccatcagatcatttcagtcacaattaaggaaagcacgaaagtgaacacattcgctgatttgaaaatcattgactattttcacaactgttgggaaggcagggtttagaagtagaaggttattttctctcagccctttgtagattctctagattctatttagacagagttggatgctaaaatggagcctttggggctgtatttccatcctccaaaacaaggtgccagagtggcttctccctactctaaccccactcttaagtgtggctctggaggaagagaccaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggtttacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggactgagaaatatcagcagagaaccctcaggagggagatgaggcctaaggagaacaggatctggttgcttggagtagggattgcactttaattgttaaacttggaggttctttcactggggagacagtgtgtgatttgttttcagtggagaagcatttctccagttctcctaacggctcttcccctgaacaatggggtcgaccagcatgggctgagacctctgactttagttgaattctccaccaactgggctctattgatagctcctgtgtgcctatccattttgcttctaatcttcacttcattacctatttgttgcatgcatgtggtttccagagttttccagcaatgaggcacagatacatacccagattagataatatttcagcagctgattagatattttgtctggagctgccctggaccccaagatatcccaggggtctaaaaatagattttggtgaaggttttccaaggtggctattactacattttaaaaaatcaaaattcaagacttgtggtttaactatactaatagagacaacatagctgaatatatgaaattgggctgtcctgaaaatccagaatgttggcatggttattatatctgtggggtagagtaacacctcatctatgggtgctagtttatcctatccctaagcgtgaacttctaggggataattcaggccaggtggggctgagacctcattcctataatacttcattgcatggagtgccctggaactaaattaggtcatttctacgattctgcatcctaaaggccaggcaggaaccacaagtgggacaagatacaggtctatattctctttatctacatgttatattctccttccccaacttaggggaaagtacctttgaaataggaagtattttaaaagaaaaccccaagtatttccaacctaaagtgaagaccaagcttgattggtcagcatggtaggcacctgctggagactcacctttgccactgagctgagtttgccctctattccgtgtgtcctccctgtccctgttcttgtaagaaactcactccagggcttcgagtcaactctctttgtcttgggcctcttcatggggatggctacccataatttcatctgggaaatgagctaaccatggctgggctgggagggactccattcagggcccttcgcccttccttagctcctggagctcttgattgccatcctcccttcccatgactgcccctgacctctcaagctcttgcaaacttctcattgctagctatcttggctctttgggatttcctctacctccttcccaacatgtgtgccctcttggtttcttgggctactcactggggccccagattcactgctgccctggactggcatttccagggattttgtgcatttaaattagatgaattgtaacccccatttcagcaacggcaaggactccaaacacaggcttcccacctgcttcttgggcccttttcctcttcctcagtttcttctacctcttcaggttcctcaggactctcactcttctgttcttcctcctcctccttcaggtcttgaagttctttggtcttctttagaccttcttggaatctggggggcaaaaaggaacagttgagtctggaaagggcagatgcagtgcatcctttcctgagttcctaggggaggggacttgagcagcacctccaataattatgtgcttcctatggttccacaaaacaggaaaaagctgggaagctccactgaatcctaaggcagctcacgccagtaccatttcccctcactcctcagtcatccttcctgtttatgtgaaagtgtgacaaaactgacagggaaaaaatgtggtgcagggtctcctgactgggttcttaacccacaaaacattccgtagggctaagattgtatttgttctccatgtgaccgtggagcttcagcctctcatctgtaaaagagagagggtgacactcatttcacagggcgttggaatgatttttgcaagtgccaggcacatggcttgatctagagaggtactcagtaaatgtttacgaaaccaatgaaggagttcatgcccataaattccaaggatagagcacagtggtgggtgagaaaggcacgctttcaaagagaaacccttgtggtttttctcccccagggtcaatattaccccaaacatactctgttcacttgtcctatgctgagtgtctaacactagcagtttggctgggcaaacccaccactgaagcccatgggttctgtgccagtgggaagctatgtcttcctcatgagctatggagacaggagacgcatagggcaccatacatggttggaggtgattctctaccttgaggcttggtacctgctcaggacttggtctctccagtgctgacaactggccatgggtgctattgaagctcaaatggaggaggaggcagttcgaagttgaagagactccatttataggaggaaggagtgaccaaagcagttctagggagcagagctgcagctgctcctgggcactgctggcagcaacatgactgctttgagcacgtgtcaggaagcctcaggcaccaccaagaggaacccatccaggacccctgatttccagactattctgagcggtggcattctggtggctctctgcctaaaaagagggcagtcttgttattgtctaaccacaccctctgaccctgcttcctcctgtccttcctgtggaacagtcttgctctttcctatgtagttccttcctgtggcaaggaggtcctgcggccactggttacttccctaaagcctctaagaaacaagaaagacccatgggaaggcatcttctgagaactgccaggtgcccttggggtggctgaggtctgactcaccccttgctgtaggcttcttcctccatcctggccttggtctcctgactaagctcctccaggcagctcagggtcagcgcaggagcagaggcttcacaatctgggtccccatttgtctttccactagtgagaagagggaagtacagggcatcatttcagaaaaaggtggaggcctaaaaacaaaaccatgtttttggcccgattcctgattaggagtgaggaaactcaggctttttcagtaactttcagattttttcccaatccttctaccctgagacaagattttataaaggtcctagtccatgaattttccccagcccattaaatacctcaccagctccccttctcctcatgctcccaaactggcgtttattcttattccaggagatgctgtaatgggtgatctacagcgctgagatgaggaaaatgggggcagaccagcacgtttaaggtcattccattcctgttgtctatctttcacctgaagacccccactcatcttttcaaatatccactcagcatgactaagccacaggcacattgtaatgtgctgggggcacattagaaaataaagaaatggtttttaccaacatggaacttagcagaaggaaaagccccaaaaaaggaaagaaaaaatatgtgattaattacaaataataacttttatgaaagaaattctgtacagtgacagaaaataacaaggagagaatgtgtttagagtgaatagttagaaaaggcctctctgaggtgctgaagttgaagcacaggcctgaaggatgagaagtcagatgtattaatagcagaggagagggttgggtgtggtggctcatgcttgtaatcccagcactttgggaggccaaggcgggcggatcacctgagatcaggagttcgagaccagcctggccaacatggtgaaaccccatctctactaaaaatacaaaaattagccaggtgtggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagatgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaaggcggaagagtaaacagtgccacacacttctgagtttgaagcgtgcagacaaggtgactattagatttgataatacagaggtcaacaggagcctctgtgtaatgttgggagccaagcacaggtttaaagtaaagaaggggaggttggaaaggggaagccacagacacagcaattcgagtaggaaggagagtagaggggtgtgttggagggagtgtgcagctgaagtaggtcaagggaggatgcacatttgaatgtaggtagaaatgatccagtagaggatgagagaaagggatgcccgaaggaactcagtctttgcaaaaggaaatagggacagaccttggaaaactagagaatctctccttgtttgtaacaaaggtaagatgatgatgaagttgttgggctggagatctggtgaaggaaagtgagagggctcctatgggaatgtagcttaggtattctctataaagtggaaggcaaggtcatctgctgagagtgagaggtagaggggtctaggaaggtctgtggagagaggaggggtgtaaaagagttatatgagaaagaaggaaaacagacatactagaacatcttggtaagatggctgggaggtgctgggagatcattgcaggtatgggatcacaagtttaaaggaagtatccagatggctatgctttccctagaaatcctgcagcccaccttcatgtcctgattcccaatgggagcaatgtcgtcatggaggagtcctccaacaaggcaacactgtgagcagagctttccagccaggactctgaaagatcacagctgccaccctccctgaactctcagacagggtttatgagtgagccttgtatcttctcctcattcttggcatcagtttcccatctcttagttttcctcagaccttttaaaatttacatttagtcaggctggaaaccacaacccattgtgaacaagaaagataacgctctaaaaataccagctgttcataacatttctccttttgcaaattacattatccactcccttccatgtgaccttggcctaatgtgcagtttcctatttatccaaacgactggagcaagaggagaaaaacatagctacagccaagggcagggaaagtaattctttcatgaaatatatatatatatatatatatatatatatatatatatgaaatgagatattggtatcagacttttgatttatatacaactgtcagccttagaggttccttaatgttaagcatgcgtgaaggaggacagtgtagtataaaggaaaagaactcgcctgaggcaaacttggattcaaataccagctccaaaacatgcaaattatttaatcttcctgaacttcagattcctcaactgtacaatggggatagtaatacatacctgatggtggaggtgtaagaattaatgaagaaatgtcaataaactttctggaatatggcactcaacaaattatatctgctattattattgttatatagtaaatgtattggtacattttgggagcaatctgagctacctccaaatatgactcataaaaaatccaggcaattatttatatcatcaagggagagcttgttatatattactgagacacttcagagtcagaggaaccctaaatgtgaactaatttaaggtatggtaaattaacattacattttcataaaatggctttaggaactttctcaggtgcatgtctattgtgtgtcatcacacattatgcaccttagaattttgcagataagtgactgtaaacaaagctctcattgtccttgggtcactgatctctagagaggaaaacttttccctagcagggccaggaagcccatttcatcgactcttttacatgcagatcttctgttcatttcagctcccctatagggctctcatatacattctctcacttgatctttccaatgataagaagagctaaacattaacttatatgtatcaggctgtggtctaacatctcatttaaggctcacaaatgacccaagaaggtattagtgttctctgtttgacagatgaggaaaccaaggctcaaaaagtaggctgaggcatgagaatcgcatttcaagtgatttcatatctgtcaaacagagaacagtaataccttcttgggtcatttgtgagccttaaatgagatgttagaacagagcctgataagtaagttaacttttagctcttcttatcattggaaagatcaagtgagagaatgtgtatgatctcgggaccagcccaagatcatacaaccagtgtgtggtagagctcaaattttaccctgtgcagtctgatatgtgcccattcttctgactgcactatctgccacctaggtggggtattatcccatttcacagataagaaacccaagctcaggttgattaagtgacttgcctaaattcacgttattggtgctgggactctcaccttggtcttctacctgtgtgtcaagatggactttccagccctccatgaacccccgcttttctttcaatagaagccttccatgaacccccacctttctttcaatagaagccctccatgaacccccacctttctttcaatagaagccctccatgaatccccctgcctttctttcaacagaagtctcttcctttcactctgctgagtgaagcccttcctgccctcaggctggaccatggcttccatgctgcccctcttttcaaggctgcttgtctacagtgtaagtggctgggagggcctttgtttactgtgtgtgtgtgtggagggtgggtaggggggagtggaggggttgtgggtagggtggcaagtgggggaaacacaacatgtaaaatgtttgctgttctctcctgacctctaaactgagcttgtagtttcctaaatatcttctctaactatctggaagtttctctctaagcatctttaagactaagctcaaatgccttctcctctgtgaaacctttgctggtgttctcccctcccccacaccctctggttaaagttgatctctcctttttttttttttttccttgagacagggtcccgctctgtcactcaggctggagtgcagtggcatgatctgggcacactgcaacctccacctcccaggttcaagcgattctcctgcctcagcctcccaagtagctgagattacaggcgtgcaccatcacgcctggctaatatttgcatttttagtagaaatggggtttcaccatgttggccaggctggtctcgaactcctggcctcaagtgatccacctgcctcggcctcccaaagtgctggggttacaggcatgagccaccgcacctggccctctctctccctttatgctgccaccgcacctctgtgacagcatgactcacagggaggcattgatgtatgttttagatacctgcatatgactgtcatcacaggaagaaggactgtgtttgggtcagaatagtgcctggcatacagtaggtgcctttaagtgcctgtcaagttgcatcggtttcactatgacttatccagtccctactaggaatgttgtaaaaggcacaagtcctctctgtaaatggttatttcctgagaacccagtgtttgggttggactaaacgaatctgtaatcatggctataaactggagctgagcacagcctgtgcccaccctagggatttctggcccgaaggctcatggatcttggcatctgtcccctgcctgaaatcctatgtgctttctttctgggatgattcatgaaaatgaggctcattattctcacacgtgcaccaggtcaaaaatgtttgtcattgtgctcagctctcagtaatgtgaagaactatttagtcaaaatatatttttggacaggcaggtatattagattcaacttttcccacatggtaaacaatatttgaaagtggctactatcctttgtgatcggcatatcttcttgggctcagcaatatttccaagtcacccccactgccatggttccctctgacaagcccagcccagggaacccaagcttccttactccgtgttactcagttctagatacctggggtccgccacaagtttattggggtgggtggcgggagggaggaattcactccaagataccatcagcaaaggggagttgcttactgtacaaatttagtgtcctgtgaaatctttaaggaatttaccctgggtgcttcaagagtatagaaacatggttatttttagagattcagagttaaaattgctctgtgatacattaacataataacccctttttgacactaaccctgtgcatcatctacatcctggttttgctgatcgctctgtgaacggttccacacacaccctgtctctcaccccgactctgttctccactccatgcccaaccggtcaccatgctctttcaaaaatagctcttaaattcatcctcttctctatggtcacactgaacttcgttttgttcttccagttgggcggtctattaaaagggtaagggcatgtgctctgctatctaccagctgtgtaacctcaggcaagtgacgatttctctgagcttcagtttcctcatctataaaacagagatattaatagtacacctacctcatggaattactgtgaggattaactgagattattaatacaaagcaattagcaaagcacttggcatacagcgaggtgcagcaaatagttaacagtaattaccattgtcatcagtgcagtagttaacagtaattaccattgtcatcagtgcagtaaatagttaacagtaattaccattgtcatcagtgctgtaaatagtcaacagtaattaccattgtcatcgttatcattatcatcattccttgaatactccatactttgtcacatggacaaagcctggaatgttgttaacctcctgttcacctagttgattatgtaccctttagatttttactttaaaagtaagttcctagagggaaacttttttttttttgttttttgagacagggtctggttctgtcgctcaggctccaggctgcagtgcagtggtgcaatctcagctcactgaaacttctcccggctggggtcaagccatcctcccacctcagcctcctgagtagctgggactacaggtggacgccaccacgcctggctaatttttatattttttgtagagatggggctttcgttatattgcccaggctggtcttcaactcttgagctcaagtcatccacttgccttggcctcccaaagtgctggggttacaggcgtgagccactgcccagccaaggggaatcattttctaagctctctcttccccccacttccccagttcccccaaccttacaccaaaatcaggttaggtgctcattttctgtgcatcattcccttagcaacctacacttccttacgatcccacccatcatgttgtattataataggctgcttcccatctgtctttcccgctagactgcaagctccttgagtacattctatgtgcctggcccttggtgattaattgctgaaggaatgaaagaacaaaagactacaattacatagccatttctacttgtggaactgctcttgagctttgttttctcttcatcttcaggactaactttaaatatcactctccacccatatgtttaagtctacaggtttctaggcccttggtgagtgaagagcagttcattacgaaatgacctccaagaacaaggctcagcattctctgaaatctcatgaagcagtgtaaccagctctcaagtatcttcctgtgaactagccacagggtatttgatcttatcctttgcttagccagtgcccttcctgctttgtcactgtatgcttaggaaaggtgaaatcattttaacacaaagctgaatacaacagtctccaaagcaatgtatattaaactataacacattatttctctttcacgatatggatagggcagttagaattgactgtatttgtgtataggacagaagatacgaattcacttttactcatatattgtctcattgttagtctgttgggaatcaagtaaattttccactttatatttatttatttatttatttgtatttttagtagagacagggtttcaccatcttggccaggcggtcttgaactcctgacctcatgaaccacccgcctcagcctcccaaactgctgggatcacaggtgtgagccaccgtgcctggccatgtttccagttttaaatggaaatcacttaacatctttgagaaatccagaaggggaagctgttgttcatcctgaacccctcttcctctaaagatgccctcacctctttgcaaccattcttacatgggtatattcccaactggcgagtcagccccagtgtgcttgacttgccttaatccccactctgtccatatctctccaggttctataaagcactggaaaggtgatgccactattgatcgtcacccattgacactcctaatttggggctgctgcttattgtctccaattttgtacctcagtttcccttaccaaggataattcatgttttcatgatccccactgccttggacagaagtgctcaactggcctggcataagttctacagagttcaggccctctctgtcatgattaagagtctgttgaagagatcttctgccttgagtggctctgcaggcctagagttgggaaaggggctagagttgagggttctctgaagtagggatctgtgcacccaaagggaaggttggcagggagaattttagtgggtttctcagtcagagcatgaggtgaccatttctggagagattcagagaccctggatgaggtactatgactctagggacttggtaagtttctgtaaactcggttacttccatgtggtggtggttgtgttgcctcttgacaatttccctgtagtgatcaagaaaagacagagagagagaccccaagagaccctctataacacgaaggacctgtgagcttatgggggtgaggtggcaaagagacgaaatgctgggcaaacttcaagactaacaaatcactgggtgataagctggtggctatacagaatgacagatgtaggaggcaggctgagtctggagatgggagcttgtctgtactgaaaagggtcccaacatacaggttccctgccagatagcaaaacttttctaacagcaaagaaaaacaaaggactaaagctgtcttgaggcaaggaagaaggaagaataaggtatatgttttaccaagtgagaaaagacacaaggggaaaattctgagaggcagcaggtgtgatccagatgtttttcagcaagcaaatgaaagaatttgaaaagtaagctataaaatcctctgagtgcatagaaacagcctgccttactctggctgaggatgaaaagatctgcaaattgcatagatgcctagaaaatcacagaaactgctggctgctaatccaatatgcattttccttcctacttcctaacagcaacatgattctgttcaggaatttactcttcttcatggagtcattttgctttatgggaagctgaccctctcaccaaccccagggaatagtttaatcccataatgacaatccctttcccaaagtgattcttttagaaagggacttccttccagatttgtcaatgagataatagagaagactggtgaaaggcttctgggtttattcctaagaaaggaacatggcaagaaacagtccctttcttcctctaggtattgtcctgtctggaggggatcccaggaactaccagccatttgccacaatcctgatgatgaagttaacatacaatgtggccagaggcaaggaagttgtagactcgctgagctagagccctgctgtgccataccaggagcagctctacctctggacttaattaagtcccattgagttggggctttattttgtctgtagcccaaggaatcccaattggcagagaaggctccagccttctctgggctctctaagattgggtacacttggcctcactcagggcatcttcctggttcaagaattttgcaaacaggttctgaaatctttgtgggtttcagactcccattcatttcccttaaaacttaatttgctttccactgcattttggggataaaaatgggaggaaggaaagtaaaatggggaaaatttcctgagagatccctgaagccaagaggaaaatcgacaaacttacttttccaaaagtgcaggcagtgctgaagtgacaggtaggctgcctttcccattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagaggagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttttaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaaaggcctgggatacagaaaatattttgttatatccaaacgtctttgtctaaaagaaatggaaatgtatttttcctgattattaccaatacattcttattatagaaatataaaaaggcatcaggaagaaaataaaaatgaactattttaccattgcctagagataaccattattagctgtttcacatatcttctaccagaaatttctatgtctacacacagaaacacactcttttaaaaagtacaaaacagaattatactgtttatacactaggttttgtatattctattttacttgcttttgattcataataaattatggataattctacagaaaccccttataggaatatccatttgcttaaccaatctcttattagtgaacatggagttgtttcccacttttcattattatgaacaatgctacaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcacttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacacaggtaagtttcaggctaggcaccagcaggaaacagaaactaggctatcgtatccatgggccagaactggccctcaagggatagcccaagggtctgggtgttggggacactgagtttggcacttcatcctttgagatggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagagcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgtcacgtaggctggagtgcagtggcacgatcttggttcactgcaacctccggctcctgggttcatgtgattctcgtgcctcagcctcccaagtagctgggattacagatgtgtgccaccacacctggttaatttttttatttttagtagaaacagggtttcgccatgttggccaggctggtctccaactcctgagcttaaagtatctacccgcctcggccgcccaaggtgctagaattacaggcatgaaccaccacacctggcctgtttttttcataatctaatctgagattctctattaaccaatagatttatactagttatagttcttgtgattaatatatttgtatttatttctaccatgtaattttatattttctatttattttgttttattcattgactttttctacccctcctcccacctgacacttttgtttggaaattatacattctatttttaacctttagcatgtcctcttaacttttgaacatactgactttaaatttaaaattaaacaagctctctattcttttcttgaataaatcttaaaataataaccctccctcttaattatattgctttccaggatttttatttcaccttgtgtttgtattcttaaattattcattatgtttgttgatttctacagagagtgcttatttagatttacccacgtttacaaatgtctttgttgactattctttcttgtatcctacttgtttcttttgagctcaattttttttaacttttattttaggttcagggtacatgtgcaggtgcattacataaacttgtcatgaagatttgttgtacagattatttcgtcacccaggtattaagcctagtagacagcattgattttttctgctcctctccctcctcctactttccaccctcaagtaggccttggtacctgttgttcccttgtttatggccatatgtactcaatgtctagctcccacttcttagtgagaacatgcagtatttggttttctcttcctgtgttagtttgctaaggataaggacctccagccccacgcatgttcctgcaaaagaggtgatctcattcttttttatggctgcatagtattccatggtgtatatgtaccacatttttctttatccaatatgtcattgatgagcatttaggttgattccatgtctttgctattgtgaaaagtgctgcaatgaacatttgtgagcatgtgtttgagttcaatttcaatcttccttaggtacatcctctagttgttctttcagcgagggtctatgagaggtaaactttctcaattgtctccaaatagtctttaccaagccctcaatcttgcatggtatcttagccatctgtgttatctctagattgacagttattttctcttagttcttttaagaaattattccattggcttcttctattattgccattgagaattgtcattcctttgtaagtaatcttctctttgatgacttttaagatcttccctttgtctttactgttctgcagtttctctttggtgtgtttttatttttcctgcttggaattcacgtattttctgaatccaatgattgatgactttccttagttctagaaaatccttagccattctttcttggcatattttctctccttggttttccccttaaggatggcctaataaatgtatttgggactttctcattctgcattctatatcccatatctcaatgcttctttcataattttaatcaatttatttctctgaactatacattgggtaacttcctcaaacctatcttcaagttaactaatttttcttcaactgtgcccaatttgatttaaatgttataatcaatcaggataagctaggttatactagtttaatagcatagtaataataagcaactccaaagtattagtggctgataacaaggaagatgtgatttgcttatgctacatgctcatttacttccaagtctgcagcaagcttggttctctgtttcctcactctggactcagcctaatactggccttctactattctggagcaatgatggttatcatgttaggaggaagaaacagggcaaactgcattctagttcttagaggcctaggttcagatgtgacatgtccttctactcatatttcattcaccaaagcaaatcccatggccttgccttgtgacttcaaggggatgggtaaatgtgcccagaagaaggagatctggaataatgaagaatagcctcaaatatagtaactaccacatctaaactcttgagtttttgatttctgtgactttattcctcattttgaggagttctattttattcttctttgataactgtattcttttactctgtttttgatccattattttatgtctccaataatttttgtttaagttagagacggtctcactctgtcatccagaatgaagtgcagtggcatgatcacagctcactgaagccttgacttcctgggctcaagcgatcctcccaccttagcctcctgataagctagaactacaggtgcccaccaccacatctgactaattgctttttatttttattttttgtggagatagggtctcactttgttgcccaggctggtctcactttgttgcccaggctggtctcaacctcctggcctcaagcgatcctttcaccttggcctcccaaagtgttaggattacagacgtgagccactgtacccagctacctgtaacaattttaagcttatcttaaaaaaattgtcagatcattttattttccgaggttcttaggatataatcctattgttttgtgtaactgatgacttttgttcatgatgaattgttttcttgtgtattttataattttaagttgtgaagtcatcttcagtgaggctttattagaggaatcctgtgtgtccagatgcagggtctgtctctccagagtacttttctgcttatttctaacatatcttagaagcaccatcttgctgttcttttcaaatcctctgcatattgcatcatcactgctgtcactttgtgagcacgtactttccctatgaggaaggagaaagtgttttttcctactacagtccagggtgaaacaaatttccttgtttctctgctggttggtgattattatttttccttatccaaattccatctgaggatatagtccttggacgcccttaactttctgtgggaatctgtgtcaactctctaccataggtgttccaggccttgtctcagaccacaggcaagtgcaaaagctcagctcccagataaccaaggctgacacttgtccctaaggaagctgcagggtcagcttggtttcagttctcttttcttttcttgtatctgggtatttcaatttattttcttgtggattcagctatttagacaaaggtttgctttattttgtccagcagcaatttctaagtgcttgtggtcaaaagattttcaagttttccagtcagccaaaatagcagaaccagaaaatattctttacatgtgaagagttcatataaattagtaaactaccaagcttacaagtggcaaaggtcataaatacagaatttttaaaagcagaaatacaaatgttccataaacatttggaaaggccaagaaatacaattaaaacaataagacaagacacaattgtggcctatcaaagtcatggatatttacaaaaagaaagaacaagaattgtgtcaatggcacggtgaattgagtattgtaacccattcagtgaaaacataaatgggttatttgaaaataatttgctttaagagccttaaaaaatttatttcccctgagctagtattcatacttctagaaatctacactaaggaaataatctaaaatgcagataattggtaaatttcatattcagaaagaaacatgttatttttaaaaaatgtatatcaccttccttgaaatcagggatattttatttactgcagtcttcaaaaccccaggcatagacaaagattgcagaggttgtataaaggcttaagacacaaacactattagggaacagtcatagagtatcttatggaaacacctgctgagtggttacggccactctgcctagcccaagctgaggtatagcttggaagaacaactggagtggaaacaaatatcagaaaaacacgtacagctatcgttgacctttcctacggtaagcgttttctcatcctcctagagtgaatgtgggactctgtggtgtattctcctcggaagtctgctttcttctgtcatagcactggctacactgccttgacttcccaaaggttgggagctcctttgggtctgtgactgtgtgccctttacctctatattccagtattatatagggcaaaccaaaggtactcaataaatgtctgtagaatgaacgaatgagactcatgggtaactgctcatcctataaatcttaggtaaggtggtttgcaggaggccttgtgcagcaataaatgcaggagtccacgcattaggattcctttggcggcaacttcctcagcttccaacactgacggaaaatggttagaggcctaggtgcatgtgggtcaggagccttgctgacagatccaaagctgacagtctggagcatgtgtgcatgctgcctttggactctgggacatgtcactgatattctccaggaaacttgtgaaacctcctgtttataaaggtttctccatctgttatactttctgtactttcccttctgcagctcttggtaacacggatgtttgcattccacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaccaatgactccccgttgcctagaggctcaaattgctagcatggcctggcgtgtggccctggtcaaccaagtctcacttccacaccctgacactgccactatgacaaactgtttgtttcatcttgttttcacccccaacctccacacctttgtccatgctggtttctccacttgggatgtgtcttcctctattgactggagaactcctatttttactttaaaacaccaacaagataccatccctctttgaaggcttctttgtctcccttcaagcagaatcaggtgggccctcccccgtgctcctatagcaattcgtatagaacttctaaacaagagtatttctttgaaacttctgtcttacccatgagtctgctgtttttctccgtaacatctccttcagccagactctcactccaccctaactgcccaggtttcacccctcacctggactgttgcaagaacatcttcatggggttttctatccctgctttgtcccagtaatgtaactgccacaccacagttaaagggaatcttcttaaactacatatatgatcaagtcattttcttgattaaaatcattggctggatccctaatgctttccagaataaagcccaaattccttagcatgtgctgcctaaaaggggatcccaaagcacacggactgacagggtctagggtcactctcagaccctgtaagtccaagagctcttgtagcccatgggctttgtatccatggtcagccactgtgatttattgctttgggagttaggaagtcactttggaaaggctcatgtttcctggttccagactgccctgccaggcccactgaagcagctgctgggaggcccctgtgggcagcactagacaggagtgctgctcaactggaaataagtcctggggctgttctgacagctctaatcctagccaagagctcttggaagtccaccttgtagggccaagatggggcaggagcctaggtccttaccagaggggccacagctgcggcttgaattctgatttgcaagctttttaaactccatgagctccgcatggtccttctcatacgtcctctttagattctccacatactgcatcatcacttccgttgctttcgacatgcgcttttcctgcggggaaggagcgcatgagtgcatgaggccattggaggaaaggctccgttggcacttatttgctctgacctagggtctgggctaggagaatcaaaaggatacagggacaagactctgccctctgaagagtttgctgtctgccatgtgagctgagaggtggactcagcacctgcgcttagggagaatgagaaaagcacagccaccacactgcaggagatgacaggcagaggagagttgtttctgcttgcagagaacgggtcaggggaggcttcatggagagggaatgcagtggatgtaggatgtgagcagcatctgggcccatagacaagggcaggagggacacagcgttcaggccagggaactccaagaggagtctagaggcagggaagcacagggcttatatgtagatgaggttttatcctctgaataagagtcctctggagagtgaagaaaggcacgacgacaaattatgctgggacaatcgacataataaaccagggctgtccagaaagcccagacactgcaggtcctcctacctatgtagggatcagcaagcagttgggtctatttgtaagtctgggttgtgaaggacctcgaatgctagacaaaggaatttgaacttattctgaaggaaaagggaagccattgaatatctcccttaaagtaagagagtaatataatcaggtcataggtagagatgggactcaagggagtgagactggtggcagtgagggcagcaggtaaaaacaggatgaagcctgacctggcccagtggagccagagaggaaggcaaagactgagacatagcagccaagacgagggagccatttggagaagggagcagatggcgtgagtgacaggtgggctgaggcacaagtttgggaagcctgcacacaatgagaacaatttctctctgctcataccccagttagatccctcagaggatctagctcaggccctgcctggccacagagggacacacccagtggcttcgcaggaacaggtcccacagtcatgcgtggctgagaccagctacttccctagagtcctcccgtgttgctgctcccagctggagtgacttcctgggcaccactgctgagtcagatgtccttgtcctgaaggacacagggtgggatggcccagcgacaggtctttcttttatttaataggaactgctcagggctgcaccaccccaggaacctcctctcatgtaaccagagcagcaggacatagattcatgtcatagcaacataataacaacatccaaatgctttacaagtacggcagcaaccctctatggcagatactgtgaccatcctcattttatacttgaaaagactgaagcagagaaacctcagtaaggggcccaaggtcacacagcgaatgaaggttggagccaggattagaactcgggcaatgtgctcctgctacaacatggggggccggggcggggctctgtatgcttcaggacttcaaagtggccaagagagagccagacctgggcctgtgccccgctccgccactaacgcttttactttctgagactctgcatcttcatctgggagacaggatatttatagggttgctgggtggatttaatgagacaaagcaggttttcctaaagtatgttttgtcaaatactagctccatgggagttgaacaggtattttttgagaaaaataaaatggagagctgtggggggaattcttcagttaaatacgtttgggaactatgtaggtaaagtgaaccagccttctccaccacaggagttaccaaagccttgattaggccaatgtgttagaaatttccaagaaagaaagatagtatgcagtagtccccaaacttgtgcgtccacagaaacctttttccacaaagcaccttgagggttcagtgatctgccaaaaatactctgaataatactgcaatgatgtgcataggatgcctggcccagaggaagccacctctaagtggtatctgtagttgccgctgcttgggtgattgctctactttacgtaggtggaacagagttggcaagaccgggggctggagagactcacctggcggacggcgcctaccacctcagctcggctggagaggcgggcagccaggcggtgcaggacagcgatgtcctccagcaacttctggtaggtttcccggtgctcacagtggtgccagagtgaagctgaggactgaacaggagtaggagcatcacctggggtcctcaaataatgttatggactaaatcagcagtccccaaccttttcggcctcagggactggtttggaagacaatttttccacaaacctggtgggggcgatggtttggggatgaaactcttccacctctgatcattagattcttataaggagggtacaacctagatccttcgcatgcacagtttacaatagggttcgtgaccctatgggaatcgaatgctgctgctgatctgacaggcggcggagctcaggaggtcatgctctcaggcagctcacctcctactgtgcagcctggttcctaacaggccatggtttggtaccggtttgcggcctggcccaggggatgcggaccactgggctaaatgtctgtgccccccacaaagtcatctgctgacttttggggggacatatcctaactcctcaatgtgatagtgaagtggggcctgggcgaggtgattaggtgaggagagtggagccccacgaatggaattagtgctcttataaaagggaccccagagagttctgttctctttccaccatgtaagatataatggaaaggtggtagtctgcaagccagagatggccctcaccagaacccgaccatgctggtgccctgatcttggccttccagcctccagaactatgagaaataaatgtttgccatttaagccacccagtctaaggccctttgttacagcaattcaaactgactaagacacacaccaagcctagactcagctctcatgaaagcagctctgggccccatccaggctgagagaagtggcctctgcagggcctgggccacagtttcttctggtgcttggagaagcccaatgtgaacacgctatccctggcgcctgaaagtaggagtcacacccaggccaccctgcccccttctgagaagctcccaaggctttggaggacctgtccacagccctgagggaaccaggcctttgggatctctgcctcagttccccccaactctctgaggaacactgtcagagtcttggctcaatttttcacttcaggagactatacttggtacctgagagaagcatgacaccctgtatggcccttggggacagtctctgctccagggattcctcacatcaggctccacaattaccgtaatggaagctttgaagttttccagttctttctcagtgttctcctctgtcaggttgcgttccctttcagcctggttaattctagattccagagtgtagctgtcatttctaaaggccaaggacagttgcacaaacacgttctgttgggaacaagggtgtgagagaggtgctgggaggagttactgcagaggacaaggctgcagctgtgctccttgcacgagcgttttgcaacggcccctggaacagccgccaaagcaccaaagcagccatgtgcaagggaaacgctcacttcacaggaaaccacaaaaaagatggtaaagcagggaccaaggtccacgctaggcccttcccagaaccggaggtccaaatgtattctaccaaaaaataagaagagaataacactttgctttttcctgaattttaagaaaataacatcctgtatctgggtttagataaactcaggccagtacagctaattgtgtaagcatctggatttatgctgggatttattgcatgaggggttttggagattttgcaggaaaatactgtattgaaagaaactccatgtgagatttaagcattgttgacgtaaagcaaacttcaatcagcatctagcccgagtattccaaatcctgtattgatagaagctttaagtagctgccaggagattaaataaggccaggtatgattctgttcggttaagctttctggaataaataaatgtttcatgctaaaattgcagcctgcatgaacagactttgaaaagataatattggtcatacatggaattcccagaacagtaggaaactactagggagaagaaatagacagatggacctcactcaggaaggaagcaatggtcttcaattttacagccatcatctgccctgagtggtagcagatttataccctgcagggttagtaaccacaggggcttctgaagttcatgtaacatggcccatggaaggcagtcatctccagaagaattgaaggtacagaattgacccaatgatgatgatgaaggcaatattgaaaactactccttattgagcatctactatatgccagcactgcttttcattctacaaattcatgtaatctcacaataaccctctggggtgggaactgttatacctgtttatgggtaaagaggccaagaccagaacggtcattaacttgttcaaggtgacacggagtaacggagccaggatttaacctcagactgtctgatttgaaagcctgttttatttccaccatgccgagagctgtgtccatatacatctgcggtcagcatttggacattaaacaaaccgcccatggcccatcttcacaaatgtcagtgggtaggcttagagctcatagcccagtgatagaaattttctgccttacccggccttggtcaagtctatgaataatgctcaatgcttaattttctataccttgattatccccttaacagcagtgtgacacaatgagttctgaattcagtgagaacacttggatctaggtcttggttttgccaactacagtatctagaaacttggtgtggttatttactcactcagttttctcctttgtgctgattcctgctccacctgcttttcagagctgctggttaggatcagctgaaaggatggctatgcgtgtgttatagactgcaagtgcaatgcctgtgtgcaagttatagatactacctgtggtagatacttcatactgtctgtcttcctctgcttatctggtccacatcagcagttctcattgtctcacctctgataagttctctttgtccgctacagaatgaaatgcagattcccctcagctcactcacaaccccgctgggacaaggaggccccagtgaggaaaccggaaggctggattgctgacagcacagcttcccggctccgctgagctggcattcttgtagctgaaaccctgaggaggccagccccctttcccactaaactaaagcttagaacttgaaatctgaccatttttcagtaattttgaaataaatttgattcaattctgcagcctcccagctggttttgtgtatctaagtcgtacatttaaagaatataaacaatccttacaggaatgtaaaatttccaactaccttctcccttttgcccaaatttgtcaaaatcttccatgaacggacgtgggaatggggatctcatggttcaagagggctggtcatgaatgttcacattaccccacagtcactctttctcatttttgtctaaaaatgtcagagctagagtctggaggaagaaatgttttgaataagcccagtcaagcacgggcactaaatttcataacacacttgagtcacttacctcaacttccttttcagtgagtggaggggcactgtgaaaaagaaaacacacaattgaactgtgtgcaacctagtcaatagacccaaaggtgactctgaatgaccagcagaccatgtgtttccaggggtggagtaagctgtgttggtgagaaggaaaagatgcaatgtccccttgcctgtgctctgtcacctgtgagatactgactcttacggcaccatgactatctctgtgactttggacaagttatttaatctctctaagccccagcgtgctcatctgcaaaatgggaatcatatcacctaccttgcagaggtattataagcactatatgtactcatgtatgtatgtgtatgtgtttgtatgcataaatatatggcatccacactcagtgggctctcgggaaatgtgaccttgaactcatagccttgctgtgagaaataagaaaatgcatgtgataaggactttataactcatacacatctaagttgccattataattgttctggggatatccacccaggtctgcaaagcctcaccctcctctgtctctgagggctgtgacaaaggtgcatgcgggccagagaataaatggtaggagagagtgaccagggttcttctccacagcaagaacttctgatggctagaatcacagagtggcaagaaagccccagccgacacagaggcatccttttgagcagctcctcgtctgtggcgttcccacagccagggctctccagctataggcagtccctgcatctgcatgtccactcgatgctgctgtggctgctgctcttgctggtaactaaagctggccccatctgaagtccacacaatgtaaataatgcacaggccctttcctgtgctggggcggggaggcctgggaggggtcctaccagcgtcacagaacttggcaacagagcatgccatcaataagcttctcaggaaacacagcttcctctcttgaacgggtgtgaagggaccccaagagcaaaggtaggggtcagccatctctgcagggggctggttctcacccctagggaatgatatgagtgccttcctgtcaggatgagaagaccccatggccatgaagtcagcggagtccagaacacgggacaaacagctgcagggatgtttgacacttacagtccttgtcacaaccccacccatcaggcccttgccttaactgtcatctacagcatacacatatgatttaaatgatttggcaaaacttgccaagtttgtttctgactcctgggtttgttgggatattatgtgaaatgcacatattttcataaattataaaccaaacatttttctatttcaatgactcacattctgcttttttgctgtagaacacacccaccttatttttattttatttatttatttttggggacagggtctcgctctgctgcccaggctggagtgcagtggcaggatcactgcagaggtggcttactacagccttgaactcctgggttcaagcaatcctcctgcctcagccaccagagtagctgggactatgggtgcatgccactatacctggctaattttttatttttattttttgtagaaacagagtttcactctgttgtccaggctggtcttaaactcttggcctcaagtgatcctcttgccttgagcctacaaagtgctaggattacaggtgtatgagccaccacacccagttagaacatacccaccttaaaaaaaaagtgggggtctggggggaaactctgaggactcagagaagtatgatttaggcagagaagccacatggtatgtctggtgtctgatgcagataactgtgccttacaaatgggcataggtacccgggggcagagctgtgagcctctaaaaggacacagcatcttttttaagtgactatttgtatatcttctctgaagaaatgtctatttaaatcctttccccattttgaaaaattggttatttatctttttattgagtgtaagccttctttatatgctctagaaacaagttccttttcagataagtgatttgcaaatatttcattctgtgggttgcctttcactttcttgacactgtttgcagcacagaagtttttattttgaggaagtactatttatttttaaaatcttgtctcttgtgtttttggtgccatatctaaaaaacccaaagacatgaagatttacttatattttttctttgaagagtcttatagtgttctctctgacatttaggtctatgatccattatgagttaatttgtgtgttttgtgtgaggtaggggtccaacttcactcttttgtatgtggctatccagttgtcccagcaccgtttgttaaaattacaatttttttcctctgtaaatcttaccaaaacccttgcatgagtggctttttgtcatttgttatttgcacatctcaaattattactttatcacagaggcctttccttgacctcctacccaatgccccactctcatgtcattctctagatgtgccctattttatggtctttctaccaactttactctttcaaatcattcatttggttacttaaatgttatttgtgctttgggaggccgaggtagaaggatcacttgaggccaggagttcaagattatcttgggcaacatagcaagaccctatctctacaaaaaaatatttgaaaacttaactagtcatgggtaaatggtgtatctgggattgaaacccatgtctcctggctcaaagcccattctctgctgccatgagcttctggtgacccttatgccttcatgaactgtgctcacctaagaaccccacctggcctttgagttgaaaacacccagcctggcctttcattattctttttgtttcgaatgcattatccctatctagacaattggactttggcccttctgggttcaagaattaagactggtgttcctctgtgtcccacctagaatccaacacaggggccactcggtacagggccttctgtaacccacatcctgattttaccttccagggagactcctgtggacccgcagtttgcgcagcagcacatcagaaatattaggcatgacatctaagccactctttgactcttcttcctcaatagctggggagagttcagaaggaagccctgaaaaaaaagtgcttacttataaaatgtctctttgaaatcacagtagtactgttggcagctagcttcaggagctttgacatttataagtatctagttctatgttaagggctttttaattgttatcttacattattctcacaatgagctagaacttagtcatcccatttcacatgtagataagccaaggctcagcaaggttaagtcacttgctcaagattacagaactagcaaatgacatggccagacctcaaggtctacctgcttcaaatgttatgttcttccctttgcttcccacagtattaagctggcaattggaagctggttggctctttggctataatgtttgggaaaaaaacctgctccttggcaggcttctcaggagacctgttgttcaattattcctcctcggataaattaaaatgttctatattatgtatcctacttagaaattaacatctgattccataccccatagataagagattttccagagtaaacctaaggttgctagatcttttacagatctcagaaacataaatgcctcctagtcaacagagacaatgaacagctttttgttttttaaacttctaaaactatcttgggtctgtgctttgaagacagaatgaacaaaccaagtattctcttttccataaatctttctcctgtttgaaaacagctcctgtgcctctctaaagcttctcttctccagactctagctccatttttccaacaagctcactgtgctccactgtggcccatggtctctagataccatcccattcctgcacacattctggtttgttgctgttacagaggcccagatgttctctaacaagatcttagcacaggaagactttggtaaatgtccctggcattgatgtttgttattcatgcagcatagattttgtgtgcctgactacgggcttacagtacacttagcattaagcaaaactctcaacctctttagttgacccaaatcagttatcctcatcctgtataatggttactttccatttgcatgtagaacttcatatttatccatgttttactctttctcctggattttaacctggtagctttccaatctgctcaatcattttccaggatcctaggctaggctagagaccaggactataggcatagttgtagccacctgaagagttaagactgggaatcatgtgaatagaaagaagtctcaccaaaggagaccatgaagagacaagaggctatctagtttggctcaaggtaaaatatgtttaaatactttgagcttgccagtaagagaatggtaggcatggattccttggtactcaaggtagccaagtaagctggaggatcatctgtcagagatgggtcagtcagcaattcttctttggatatgagattcaactagaagttctcttagctacctgttacctctctggttctgtcctggtatttatagctctctgacaaggtttctgtggtaaaccttgtgtcacccctggcatcattctacctttatgtatgtatccctaccacactcaacagagagtcaactgagtagcaagctcctgagatatctataggatgatcgaaacatatgaggtctaataatcaagtgaaatgcatatcagggtttttgcctagaaaagtttcccaaaatggtgcttgaagagtaatgccagaattggtggattctaggaaccaaccaccttcctcctgaattcaaccaaattaacaacaaaaaatttcagaacaaataaaaaatacacaagaaactctaagatacaagaaaaggcaatagtctttaaaaatagtgactagagaaagaataaaaattactaggaataaatgtagagcttccacccatgataaccctttcttcttctccaaagaatcagtactgaaaggaagatgggagagaaaaaattcttacaaagagttcaataccacagaatagagagggaaagggatggagggggcaagtaggcagttgtcagaggagattcagaaagtttccctagaatagaaggttctccattccatcttaccagcatttcgaagagagaaaaaactgcctgggctgcctgccattttgcttttcttactgatgagaagaagagaggaaaggcagaatgatcgcacagaacacagagtggattttcttgaatgatatgaagggatttacaaggaaggaagactaacggtaaagtaaataaaacacgtccctctgaaggagtgaatggcaggagacacatggaaagccccaaccaccatgttctcccccgactcctgaaaaacagtggctaaactccttggatttgccgttttttccttcctttcttagcagaggagtagccgttgggaagcattgggtcaagtctggaaaataaacctacggacagcttgtctctacaattccaacctaaattggtgaaacaatctgaaacccactactaaccacctccaaaggaataagatatgcccccgatttggtataacaaactcacgttttggactatgaacagagttacggaaaaagagaagaaaccaattctacaaacagctctatcttaacttccccttttccccaccacctaagcagtaacaaaacaaacacaaaatatacaatcctcaactaaagcactaaagggaaggctaagagatcccagctaaggtaggaaggagtcaacaaaaactaacctacaatacaatatatctagggaaagggaatcaaggtagaaatatacaaatcagaaaaaaataaaaggaaaacagatggcatggcaactatacaaaaatactatagacaaaagaggaaggaaggtagaaaggaaggaaaagggaaatgtgcaagagacagatgtcaggatggaaacatagttgcaagaaacacatcaaaaaatgcaaaagtatgcttctgtgcaaaatatataccataaatactttgactctagaaaaaataacctgaaaaaaaattaagaaattagagttgggatgagaagatcatgcaaagatggaagatgattgctatttaaggaaacaaattaaagaccaaaataaaaggactaatcaagaaattgggaaatatacaaccaaccaatttattggaaaaatgaaggaataaagcagatatagcttcaagctgaattagaggagggtggtagagattgagtaatcataacgaatgcaaagaaggaaagaaagattgaagtatatggagataaaataatggacctggagttgagactctgatgacccatctatgcattatgttgtctccgaagcagtgaacaaaacaaatggaacaaaggacatattcaaagatataacagaagaaaaatgttcctcacttgaggggaaagttgaacccttcaggttgacagaccgcatcatgttaaaaaatatatttaaatgcttcatacaaaaaaaaaaaaaaaaacccagacatctacatgggaaagtgaagattaagaggtgctggaaatcagctggtcccagctttctccataactttaaatacaggggagcaacatctacgcagttccaaggaaaacagtcaaccaagaattttgtaaccacacaagctgtccttcaagaaaagacaaaattttcaaatgtgatagaactcagggaacacagcacctctgaactctttcaggaaaattgttggaaaacaaaatccagctaaacaagacataaatcgaataaatttgggaaagggaccagtggtgaacatgaaatctttttacatttaagtctaaggctaaataactgtggaaaccatggttacagaatatggaatgtaaatgttataaccttaatgatgtacaaagaagaattcaagatgtgtagaggtagaaatggaaatgtaggaagaaatgtgaaggtgggaagatattcggccattctcatcttttcctgcaggaagtcagtaggtaccattgtagtgactacatgttcttatcttccgtattcttgatgttctgtcacttggtgccttaatcctggagtgacagcccctctcaaggctagctaattcctagaaacaactctccttcaagtgtgtctttgaaatacaaaccagccaatccagaacccacacctgtaaacatcacctttatcaaattctcacgcaccaagccaatactccccctaaatcaccccagggccagtacctgacaactacgggccaccctatagcctaggtcctgccaaaattattcaaactagccaaccctaaacatactgaggatacctaccctgcctctacctttcctttccaagaaaaccccagtaaaggcttggggccatctctcccctcaccacttctgccttctgacccaccctagcccttccccaaggggctctgtatgatgtgccacacatcctgctattagggatctgtgagtataaacctattccttcatgagaatcatttgtgggtctctgtgtcataccatacctgattaaaacaaatgccaggtccaaagtttagattaaatttaaaacctataatgcaaaaaaactacctcataatttatagatttcatgccatccccatcaagctaccaatgactttcttcacagaattggaaaaaatactttaaagttcatgtggaaccgaaaaagagcctgcattgccaagacaatcctaagccaaaagaacaaagctggaggcatcatgctgtctgacttcaaactatactacaaggctacagtaaccaaaacagcatggtactggtaccaaaacagagatatagaccaatggaacagaacaaagccctcagaaataataccacacatctacaaccatctgatctttgacaaacctgacaaaaacaagaaatggggaaaggagtcctatttaataaatggtgctgggaaaactggctagccatatgtagaaagctgaaactggattccttccttacaccttatacaaaaattaattcaagatcaattaaggacttcaatgttagacctaaaacctaaaaaccctagaagaaaacctaggcaataccattcaggacataggcatgggcaaggacttcatgtctaaaacaccaaaagcaatggcaacaaaagccaaaattgacaaatgggatctaattaaagagcttctgcacagcaaaagaaactaccatcagagtgaacaggcaacctacagaacaggagaaaatttttgcaatctactcatctgacaaagggctaatatccagaatctacaaagaactcaaacaaatttacaggaaaaaaacaaccccatcaaaaagtgggcaaaggatatgaacagacacttctcaaaagaagacatttatgcagccaacagacacatggaaaaatgctcattatcactggccatcagagaaatgcaaatcaaaaccacaatgagataccatctcaccccagttagaatggcgatcattaaaaagtcaggaaacaacaggtgctggagaggatatggagaaataggaacacttttacactgttggtgggactatgaactggttcaaccattgtggaagacagtgtggcgattcctcaaggatctagaagtagaaataccatttgacccagccatcccattactggatatatacccaaaggattataaatcatgctgttataaagacacatgcacacgtatgtttattgcagcactattcacaatagcaaagacttggaaccaacccaaatgtccatcaatgatagactggattaagaaaatgtggcacatatacaccatggaatactatgcacccataaaaaaggatgagttcatgtcctttgtagggacatggatgaagctggaaaccatcattctcagcaaactatcgcagggacaaaaaaccaaacaccgcatgttctcactcataggcgggaattgaacaatgagaacacttggacacaggaaggggaacatcacacaccggggcctgtggtggggtccgggggatgggggagggatagcattagcagatatacctaatgtaaatgacgagttaatgggtgcagcacaccaacatggcacatgtatacatatgtaacaaacttgcacgttgtgcacatgtaccttagaacttaaagtataataataaaaaaaagtatattactaagtgaaaaaagcaaggtttggaacaccttgtataatatactacgatttatgtttaaaaaatccacttttggctgggcgcggtggctctcgcctgtaatctcagccctttgggaggccgaggcgggcggatcacgaggtcaggacatcgagaccatcctggctaacgtggtgaaaccctagctctactaaaaatacaaaaaattagcccggcgtggtggcgagcgcctgtagtcccggccgaggaaggagagcggcgtgaatccgggaggtggagcttgcagtgagctgagatggcaccactgcactccagcctgggtgacagtgagactccatctcaaaaaaaaaaaaaaagaaaaatccacttttacatatatgtctatatttagaaatgcttggaatatatctagaagttacactaaaacatagtgacagtggttgcctctgctactgggggacagagatgtaatgagacttactttttcctatgtctcattttgtactttttgaattttgtactatggacatgattatttataaaaattgaattaaaactcataccaaagcaaaaacaaaaaacaaaaaacaaaaaacaaaaaactacctcagtaactccaaaccctttatgcatttcataatacattttttatacttttagaaaccaatttctcttctttggaggaagcagttaccaaaattcagcaagtcttatagtttcacttcaagttcaattaaattctaatagttttaatttcaaacaagtatatctagtataatctccctctttttcccttcctccttctgtattagtggggaaggaggtgtttagtgtaagctatttttactttcttccttgtatttttcactattggttgaatttttagatatgaacataagccactttcaacaaaaagtaataaatttattttcaaatatatctcccaggactagctcattccaatgaaaatatttgtttctgaccatgtcagggacttggaaaaattacttttggagctctgaaagatgctctgagtcccaggatggttcctaaaagtcaaagctgctagttggggataaacttttttttacctctttcttctcagggaggcctctttcctgcccaagacctgaggctctgagtctagactgggggttttggaaggactgtccattcgatgtacttctctgcctcagcctacgtgtccctcaaaatccaggtccagatagccaactaccttctagacgttgccacctggttaaggagaataaaaatcatttcaagagccaccatttactgaacatcaactatgcagtagatacactttgtcatttcttacaatagtactgcaaataaaaaatagcttaaacacctccttccccacaaatacagaaggagcaagggaaaaagagggagattatactagatatacttttttgaaattaaaagtattagagtttaattgaacttgaagtgaagtgaaactgtaggacctgctgaattttggtaattgcttcctccaaagaagagaaattggtttctgaaagtacaaagaatgtattatgaaatgcattttctggagaaactgaagctcagctgagttaaagtgatttactagggtccagcttatcagcagtacagccagaatgcaaaaccaggtttgtctgttgcattcaagctgctttccgtgggcatttgacatgtccaaactcaaattcactgtcttccttctcaagcaaactcctcctcctgtctcacaattcatcaccctcacaaccatgcagacaggtgcctggtggtattcctggtctgcctctcaactccatctcctcatcaagtcctgacaagctgatctccaatagctgtcaaactatcctgtccacatttactaccacctcattacctctcaccaggctatttccctatccttttacctggtgtctccctgtctctagcctctgctgtttcaggccagctctcacaatctgtccagaagaattattctaaaatatagatttgatcctgatgcttccttacctgcaggcttctctttccaaagtgtcctaaatgaaattcaaactcattaattggccttcaaagccttcaatttccttggtctcagcccactgttcccaccttgttgcccatctctctgggacgtgtagctcacacttagttcacatgacattccttctgttcctgaagtatgccaagcactagaagatgcctacatgcttttgcttctgctgtccccctgcttgggatgactttctcttccccagctcaaggtggctcctcctgaaaaccttccctgactcaaccccactgagctagctgcttcttcctctttgttcccaggtactttatggcctgttaaagttttatcacaatttatcgtagtgactttgtctattcttatgtttcctctcctagacagtgagcttattcgttcatacatttgtttaatgtttattgagtgtttactatgtccctggcaatgagctgggagctaaggatacaatgctaagcaaaactgacatgccacatcctctggagctcattattcaggggaacagagattaatcagagaaacatccaaacaatttcacactgagagattttacaaaggagaagggatccgaaggtaccagcaaacccttcccaagaaaagtgacatgagcagatatctaaagattgagttgggagttcattaggcaaagagggagagaggaagaacattccatgcagaagacagaatgtgccatgcgtaagaagaggaaagaatgagctgccgaaggcaggccaaaatattgtgagtgagagtgagtgtggccctagaatatgctggggaagtgggtggggttaactattcagggccttgtaggttctactgaggattcaagtgctcttcctaagagcagaatgaagcctctgaagatgctgaaacagatttgccttctagagatccctgcggctgctgtgttggccatggtgtgagctgggttgggggttgggagtgcagggagaggggaccaggttgcaggctgttgagttagccaaggggactgataatggtagctgggacaaggccttctccctgatggtggggcctgaacccttttcacttaatgcatccccagcacacagcctaagaactggcccacagtcagtctcacatatttggcttgaaataacctgcaactgatcaaagatcaaaacagcatacaatatagttcctgagaagggaactgattgggttgttggaaagactagatgcagcacagaaatgagcctcccagtcctcacaaactgaaggagagccaaaattcttcagactccagaatgttctgataagtatcttttcccatttctcaaaggaacagccaacaaccatcataagagactggatttttccccatgagttcatatgcagggctgtatttagtgcctataaatacaatctgagccagctctcataaaatgctcccaaagccttttatcctgggtatgggaggggacggggctctttgatggggctttcagaatataagaaaagaaagtcacaagtctgcaagtattcattaaacacggagggttgcccaccacatctctagcactgtggagcacagtgtacaagaatatcccatttggttggcaagatagagttctacaacctaaatgacagaaatgaaaatgtatgccaggttcctgctggaataaagaccagtatcacatgcaaacattacagcagcttagtgaagtaggtactgttattaacctcctttaaaagatgaacaaactgaagcgtggagagaattagaaccttgaccaaggctatgcagctggtaagtgatgaagtctgagctcttaagcatccagaccctagaactgagagaaaatgagagggagtgtatattgttggacactgaccatggttaattttatttttaaaatttggtgcttataggagtcacattcatttgcctgataattttacttctaagatccatcttatgccctattaatattggataataaagttttgctgtaggtagtggatgtctaaattggtataattttgtaagctaatctggcagtgtgcacatatacatttaaaagtaaatacttttaaccaatcaattgcaagtctagaatagtagcccatggaaaaaacagatttctataaagatctatgtaagatagtattcattataacagtgtttttaatagagaaaaaaagtggaaatattattacaactggggagaagtagtatttttataatgattgaaataatagaagacttctcaaagggaaagataggcaaacatgattatgtaaaatctttacaattcctctaaaataacacaaaacgtattaaaaagcaaaaaaaagattgaatgaaaatatattaaaatacagccccccccaaaagaaagaaagccaattaagggctaatatctataatgtatcaagtttacatatattaccaacaaaaaccaaacaaatcaacgaaaaaccccagacctaaatgggtacacgggcaaagatgtaagaagttaagtcacccagtaagaaaacaaagtgactattttaacattttaagtttgagcttcctagcaaattaattgaaataataatgaaatttcacactaataataataaacttaaaacaatgacaattattgattattcttactatattctgaataataaggagcagaagcaaacaccagcacgggtaatgcgtaagagaaagatgtccattcagtctttgtcagtagcgttattcattgtaagtaatttgggaaatgcaaatgtttctactctttaaccttgtgattctcaagtctgaacacttatctcaagggaatgatttaaaggaagaaaaaagaacaactaacggtccataattgtttatactagcattgttaatcctagttcaaagaacaatagataggtcaatacaagaggaactatgcacccattaaatcataactgaggagaaattgctgagtataaaataacaagtaaaaaaaagaagctgtatctattcatcaaatcaactgaaaacattataaatatgggcaaatattgcaaagaagaaaaattgttagtttttcagaattgatggggttgtgggtgaaattttaaagtgttttttccagtgttttaaatatgctttagtaaatttaaaattataattagagaagtatatgctgcattttcaaaagatctctttaaagatggttatttaaaatattttgcccttgggaaaaaacactgtttgaaattttacttctgggaaccttcttattaatgctgaataaataggtaggtgtaagttactacagttcagaccaggggcttccaccattgttagtgacatcctggacacattcacccaagaatccatagggctcttatgctgagactggcccccagcagcttgaagcggggcaaggattttcaaatggtgctctgtgaagcctgggtccctggaggtaccttgggcccacagtctcagaagatgaaggatccaagcccttctatccccttcaaccagagcagccccatttgcatctccccaacacgctggcctcctacagatcagcttgtctgaaatgttgtgcagcttaaaaaaagttttaaaactgttcatgagatggccaaaccatgagatttggagtcaggagatcctcgggcctcagtttcctcaactataagagcaagaatccctgcccctcttagctgactgggaagattacataaaatcagaggtaacaaaatggtttatactgtggaaaatgctatgggaagtttattaattaagattgaattaaaaggactaggtgacacggatgaaccttgaagatgttttactaattgaaatgagctcgacacaaaaggacagatactgtatgattccatttctaggagggatctagaagagtcaaatacatagagacagaaagtagaaggtgatcaccaggggctggggagggagggaataaagagttattgttttaatgagtatggcatttcagtttgcaatgatgaaaacgttctagaaatggatagtggtgatggcttcataatatgaatgtacttactgccactgaactgtatacttaaaaatggctaaaatggcaagttgaatgttatatatatttacaataaaaaatagtcccccaccccctctgaaaaagggagtactatatagagtaaaatacaaaagaaagtcaagaaagtagaagattgcagagctggtgggactaacccactgctttaaggaacaggtaccatatgactcagagaggagggagatagcccagcaggagggagatgccgcggggacagaggcacagaggctagagggtgagtggccacagagaagaggctctgggaagagggaagagccaggagcctggcctgttggaaacactcatctctctccactcacccatgcctctttgcccacctcatggcactatggttacagttacaaattattttcatgtacctatctcaatgctcctgccacatctttttaaaaatgtttcttttgagacaggatctcactctgtaccccagagcgagaccctagagtacagtggcacgatcacagttcactgcagccttgacctcccaggctcaagcgatcctcccacctcagcctcccgggtagctgggactacaggtgtgtgtcaccatgcccaggtaatttttgtattttttgtagagatggggcttcgtcatgctgcccagactggtctcaaagtcctcagctcaagcaagccacctccctcccaaagtgctgggattacaggttcacctagccccctgccacatctcatacaatttcattcgttcattcaacaaatacctatgcaggccctagtagtgccaggcattgttgtaagcagtggacacacacacacacacacacacacactcctgcccttgggggcttcttctctagggataatagctgacacctagataacacctgtcatgtaccaggtattgttttaggtactttatagatattagctgctttaatctccataatcacctaagaaggcaggtactgttcttagcctggttttacatgcccagggaggttgaatagcttgcccaggtcacctgagtggtagcagggcttacagttccaactcgtggtggggctcgacatactcatgcaggagaatggggccgaggaagggtgttgggggcactgggagcagggctggacttgcccagctagatctagaggggtcagaaccctactgagaacatcggcagaggtgagtgcagagagggaggcagtgcgggggctgaagcctcattttcagaaccattttccccgccatggttctggcagaaggtggacagggaaccagaggcttggaggaaggggcctgcagctacccagcagggcagggctggggtatggactttgtggtgacagcagattagtaagcaagagatggccgtgatgccttgaaaagaggaactcttcagtttgggcagcttcctgggtgtacgaggaaaaggaagtgtcaaaagttcaggcctgaggcacccttccaggcccactagatgccagcatggcttagggagggctgacagcgaggcctgggggctggttggaaggaggcaggtttggaggtgctgagcgggcagaagacacaatcggattcattcattcaccagcaaatgtttcctgaggaagacacaggaagtcttgtgtttacacattcaccttccttgatctggcacagacaaatcagcactcgctgagacagcatctgccccaaccccacctacctttttcctgctcagctgcttcactaaggtctggaagcttgagccccactaagttctgatttctcatcaggatgtgctcctttgtggtaaaagaaagagataacaatttcagatgatgacactgggctgggctgttctcttggctctgtctatggttctgcgaccactatcttaggtgggaaagcggggcagcctgagaggtgggtgggcaggcatggcatggtgaggcctgagaagcaccaggaaatagttcctctcccagtccgtgaaggtgcctgaaacgccactgtcagcaccactttccatgggtcagggactacccttggcatggtctttttaaacaagtctgtgggcttcagggtaaatgaactgcttggcctcactgtggctgaggtttgcaaaggacacacaggggcagaactaagggctctgggacaggagggtcccctgggtgtgtatggcgctgctcctggaaacagctttggcgatctcatggctggctggatcttcctgccctgtcattccgggcagtgactgctcacttccaggagctgcgattgccccacacactcaggtcatcaatggccttttatggcacctcttgagtttttaaactctccagaaaagtgaggcctgagaattgctggcttagggcctcagctggcagagcccggggagagatgggatgtggcccaagtgggctcacacctgctctaagccaattagcaccagaccaaggacctgagtggaggcacctggcagagctccttgcccctgtgacttatggatcttcagtctgctgtgtggcagagggcacttgggaatggtttgtcccccgagaagggaggaaaggaaggggccagcagagggtgctcatgatccaagtggaagtcatggtcaaggaccctttacccatttggttagcaagccagaggcccacagcccatcagcttcagcacactggagtcgggtaggggctgggcactcaggtgccagggtagtggttagtgacatggggcctccaggttccctgtaacttctctgggtgggcgaaatctgcaggagtgtagggagtgaggaggctctgataaccagaggcccatgaaggcaaatccctggctatcggccccttggctccaacttccgctagagatccgggactgtggcaactcctctgggccctgtgctgtttgatccgctagttagttgggtctttctgactaggaggagttttgtgtgtaaaatgttaacatcagcagccacgccccagctcccctgtgcctccagttcagagcatcatgaaggtatctgaataggatagtggccagcattggaatgtgtccctgccagcacacaaatcccctcaattgtgcttgagtgctatcgggcaccttcttttcttccctgccccacatttccctctgtagaggagccaggagaagcctcctgctctgagggtgctgggcctcactctgtggaatccaggtgccttggtttatattccaagtgggccttctggaggagacaggactggtcagaattgctttgtcctgttatctggtctctatctctggatgcccccaatcataccctgcatagggtggcaaccccacaggagaccgctgtgcctggtttgatggccaacagaagctgaggggacaccatgggcactggaagaaactcaccatgggcggagcagccttcacacttgcagatggacttaaagcttttgttaacaggcatcaggaaggaaggcttgggggcatcacaaaggaaatcactatttcacccttgctagctaatcctaggcatgactgggcactccatcaagggattcctgtttatgagccactgactccggttggaggaggaaagcagcccaggactgaggggcccacatgtccctccacacgtctgccttcccctgagatgtggctttgtgtggcaactagattttagactgagctctgcctggtaactggcataaaaaagcacctaaaactggtatttaggaaagagatgccacataaataggcctgacttctcagagtgggaaaatttacgccctcacaaggcccaagtccaggccagagctgccctggccaggggcccagactcagccctgaggtcttcagcccagggagtacctggagtacacactctgcccaactggcccccaggaacccacctctcggagcttggtcagtttctgcatccgcacgggctgcacttgtatctgaaagtctttgagaccaggggccttggccagcttgccgccggccttgcctgcaaaacgcttttcttcctctgccagtggcagcttggcaagcactttctgcagccgggggccaggttcttcagggccactgtcccaggagagccctcgcagcagcgggggccgggacacagtgggtggaagctcagctttggagccagcctcgggccccatcggctctccagctgggcctctcccctgggaggctgggggacccactcctgccgcatcctgggttggacttctcggcagagggctgccctcccagcccgttttcaagagctgcttccccagctcgctctccacggggccaggctgagggctgttcagggccattttcccactgctgtttgtaacaggagctaggcctttgggtgtggtctcggggtactggaggggatcgaagttttccttttgttctattgcaatctctttggacttctcaactggaggaggacgaggagccagcctgccctgagacactttcctctggtcattctgcttcctgtcagctagccctttggggacgttctgaaaaagacaaggtagagctggaaccctcgggggcaggttgaggggaaacaggtgaggccacttctgctgtggagtctctgcccccacacaccttgccaaggggcccatttgtataagtgtgtatggggtatgagtggacgatgtggaaggagagggcttctgcccgaggtttgtcaaacagacaggaaaatggaacctgcaatccaaaaccagccaagaatttcccaagggataggagctgaggaaaactgaatagaaggcagctttggccctaactcagttgccccagatctagccttggtgctgcttagcaaggcccttaactcttagggacccaggtttgtgaaccctctgaaattatgtatgtgtatgtctgtgtgtggaggggtgtttttctaggaaaaacatccacagctttcaacaatttctcagagttccatgatccaaagaggttagggatcattggatggggtgattcttgcaaaggtgatgtcttcctgctcagaagctctaagattctgcagtgttagtttactttgttcattccccaagggaaacctgggccgtgagcagcacgtgggtctgggggtctgtgtggctgcctcgtgtgtgctgagactcttccagaggactgtatcccagacccagttccaggtgacactaaattctactgctgcccttgaaacactgagcacgtgggcccctcgatgtgagcagggtggggcgcttctgttgctcatcaacaaagatgaggttttcccggcttccccagacagaatcccaggcaggggctggcgctttcctgcccttttcactggagctgacaggagccacagtctcacctggcctggaggtcccccttgtctccaaccagcagcctgactgggggtcagcgctgtgagtattgcctccacggagttcacccccctgaatcctgcctccccacccctccaccttagacttctagtcactataaggcaggggaatctgctgtttccccagccctgaccctccactcatacgtgtgcatgcacacacacttgaaggctgcccaggagccagcctaggcttctaggagactgtgccccccacactcaaatcatccaaagggagcaaagctcaaactcacaggctcgccagggtgaggtgaagagacgtcggcctcatcccccttctgctggagaaggtgaacaggagtcagtcagcaatgggaagagaccgtgtttcctcttgaaatatccccaaggaggccccctagcagtggtgttcatgccctccacccagcaccctcatctccagtgggtcacgaagggcctcctggtgttcggggtaaggggagagacccattggcatagaaacagcacagcaggtggggggtcctgtcacctgtggtggtgctccaggcagaggggatggcgggccactgcacacatccaaacctggaagggtccagacactagtgagtgaggcccagcagcccaggccctcagctgtgctttcagccacatctccctccccgggctatcctccctttgcaatctcaggcctggaagatttgctgactacctcccgtgtgccaggttctcaggtgggccctcacagaatgttcacagagaccacaggaggaaactgaggcacagggaaatcaaagtctcatggccaggaaatgtcagcactgagatttgggcccaggctgcctggccccgacctgagcgtgccctgccgcactgatgagggccggttgcccttcctggcaccctccccctttccttgttggctggagggtgtgactctgggtacagcctaatgaaagggaagaagtcagaccccaaagaggcctttctgtataagctcttgagggcttctctgagcctccctgagccagagaggctgtcctagtcccctttcccacccagccttcctgaccctggggtacacctgcctcccgacacaagcccaagatgctaacagaaagtctatctgcctcctctgggtggcccagcaaatgccccccctggagaggggtcttgctctgggtgtgaaggggccatcagagttcttgaaggggaagcctgcaggctgggaggcatgctgatctgtccaggctgagctgccacccagagcgagaggcagggcaggaagtccccgggcagctgggcctcacctggcggggtggggactgtaagtgagttgctccgagaggatgtaggagaagcgctggggctgaggttcggggaaacagctgtgaagacagacacaaattggctggcattcatgaaggtttaggacttcaacctggcaaaggcatccttttaggtattcccaggccctgggaactgggtctgccttgctgggctcaggggctgatgctggactgcaatatgatgctcctgttacagcccaacccctccctgctgctgctcaagagatgggtgccctcaggccatttgggggttcgaggatagagtcacacttctcagcctgcctggcctgacctcaaggcactgtccagaaactgaggcctggcgttggttggcaggtacagctccagaggctgctccttctcgacttcccagggtggccctgacttcaaaagctccccttgtcctcctaagtacacttacacacttgcccaactttttgctcaggaagaaaagtgactctagcatagaggaagcaggaggatttctgggcccaggaaaaccttccctctaacccagaaattccccaaagaccatctcctcttccccagagggcctaggatccttcccagcacccacagagatcaagggaagggagcccaggacagaatcctgacctctgctgaggagagcaggtgagtccaaggcgacctcctcggaggtgaggcgcccactgcagctggtgccaggcccttccctcccgaccctagaggggctcagggcagccacctgtacatcctgccaccctacctgatggggagtctccggggctgctcctggacttcctcccacggcgggtcaggaatcgctcactcaccaacttggcttcttccagcagcgccaggtttttcttcttgtcctcctctgagatgctgatgtctggcagctggtcattcaccaggtcaatgatgtgccccgcggggtctgcagaaggaggatgagctggggtgagagccactgcatccgtggccccaggctgaggtcatgccataccatgcctcatcccagggactctgcccacagctgacccagccagccaaacctcagcccagtgccatcaagagggttgcatggggacagacagtggcttcctctgcaggcctggcccctatggcttatggcctgtggtcctccgtcacaaatggtcctggagccatctcaggttcccagaattttcctaaactctgtcaggaagggaaggccacccaggagccttacctccggcaccatctgcgcccccagtgcattcttgcttctggcctgtttctttcacaagctaatgcgcttaaggtttgtgaataaaagaaggagaccaaagatcattggccacggccacaaccccgtggccaccttccctccagtcacattgttcaccccatttttctccaaaactgcccctctggatgaggtgggtgaacggcaccacctctcacctggctgctcaggatcacaggagtcactccccacttctccctcttcctccctcccccaacatccaatcagttgatcaagtcctccctgcatttacctataaacatctctggagcctgttcctcatctccattcttgctcattagctcttttttttttttttctttttttgagacagagtctcactctgtggcccaggctggagtgcagtggcacaatctcggctcactgcaacctctgcctcctgggttcaagtgattctcctgcctcagcctcgctcgtacttgttagctctttcctggacaattatgtcttctacctaagaggtccctgccctcaggcgagctcctccatcccatcccccactgcctatcagagtggctatcagagccacatctggccatgccattctccacctcatctcatggggatttctcatgctcctcagtgtggtatccaaaccctaaactgggctcagccagtcttgctggcccccacatactcctcccaagtccctccacttcagctgtgtctgcagtgaacagctcccatttcacctccatcgggttccattcgtctttgggcagcagatccttggttttcacttggtaaaaacctctctgattccccattagctaacccccctcccctgtgccaagagtgggaatgtggactagtcttggccaatcaatgaacagaatccccttggccacagggattggctcggggatggccatgtgaagccattgaggggcaatcctggtgtggagtatatggggaagaagaactctccactgatggggcgtaagcttggagttgctggtagctattggctaccatgtgttgaagagtctgccaagaagaaagctaacacacaagaaaaaaggttcaagagatggaatgggacaattgctaataacccactttgagcacctggatccagcactacctgaaatcacaagccctggcttttgtaaatttttttttggtgtgaggtagtttgagttgggtttctatcatttgaaaaagtcccaattggtacacatggcagagtttcagttgccagcaacatgctccagggaggttcctgctctttcagtgtgtttcctattccccctggaatgcctttcctccctcgcctatctgtccagctctctaaggcacaactcaaatgccacctcctctggaataccttcctaaaacttcctctcctcagagagactcggtccccttcttgccttggctggcctagctcttctgtgcagtctcttatcatacagtgtcccaattatctgttcatttctcagtctcttcatagtctatgagcagcatgaaggcagggaccaactctatatgagatctatgttccaacagcccagggcagatcgtgagccaccatctggggatgagcagatgaccagggcagccggccttacactcaggcacctactccaacctggatgtgggcctctttagcagaggctggaggactctgccccctaaaccccagaaatgagtttcactcagctgttctttctttctttgacttctgcatcttcctcttcatgccctggtcttgtcttttgagcaatgaaaactgaattaaatatgcttctcctagacccagacacggaggggctgatctaccctgtcctgttggacttatcgggagggagcgccttaaagagcaggagagaggaaggagtcaagcccagccacgctgccagacctgtctttctactcaacatgccttagattgccctggtccttacccacagatgtcagggaggcagtggacaccttcaagtgtcggtgagaaagcctcttgtggggactgtgaactctgaaagacagaacagtcatcttgttcagaaaatcaatccacaacttgaaaataggtgaaaagatgcctgtatattctttttctttttctttctttctttctttgtttccttctttccttctttctttctttttttttttttttgactcagttttactctgtcacccaggctggagtgcagtggcgcaatctcagctcactgcagcctctgcctcccaggttcaagcaattctcctgcctcagcctcccaagtatctgagactacaggcatgtgccaccacacccagctaatttttgtatttttagtggagatggggtttcaccatgtcagccaggctggtcttgaactcctgacctcaggtgatctgcccgccttggcctcccaaagtgctgggattacaggtatgagccactgtgcccagccagatgcctgtatattctttcaaagtcatcctagaacatcatcttacaagcttctcgagggtttctctgactctcaacttgggaacgtcttagaaatgcaaattctcaggccccaactcagatcagaaattctggaggtgggcccagccagctatgattttacagctctccaggtgattctgacgcgtgctaaagttttccaaccactgccctaagaggatgtgactttgacttactatttcctactcattaggtcccagactctgagctaacatctaacttgtagaagcctcataaaatgtaaatcattgttgtctgacaaagacgcagatgatttctgtttgggaaaaaagacaaaaatatggtttcattgccctgtagaacattcacctattttatatctaacttagcagttttattccagcactttcctccccactgatgatatatgtatatccattgcttgtatcctcctttgaaccggctttgttatccagatgcttcttgtattaatgaggtaagtaaatctttgacatatgctcagtatatttatatgagaattatctttttccttttctttttctttctttctttttttttttttttttgagacggagtctcgcactgtcgcccaggctggagtgcagtggcgcgatctgggctcactgcaagctccgcctcccgggttcacgccattctcctgcctcagcctcccgagtagctgggactacaggcgcccgccaccacacccggctaatttttctgtatttgtagtagagacgtggtttcactgtgttagccaggatggtctcgatctcctgacctcatgattcacccgccttggcctcccaaagtgctaggattacaggcatgagccactgcgcccggccgagaattatctttttaactttttgaaaattagacagtctcatttcagcgagcccagttcgtgggctagtgctctgtgaaaccaaggcggagacattcctctacctgtgagcccatgtccctgccaagagatcatatttcacacgttttggccaggggcaggattctacattcaaacacctgcacctttcatgtttggctgcaaatagctggacagttattatgggaaactctcctgcggtgatttatgcttttcttaaaggctagccctttccatgggggaacaagtccttctggggcccctgggcattaaatgttttaacctccactagccctgctgggggaggaggctgcaaatgggctggagccgtcgcagagccaaaaggaccacatccaggagaggaaaaatcattttaggaggaagataatggaaaaattcctatttctatcttgtattttgaaaaactgcttgattatagtttagtcaataaaatgatacaagaaaaaagaaaagatttatttaaaaatatagctgtctgatcctcatgttctaggaaatattgtttgtcacaatgcaaggatcaggcacctgtacctgttggccaggtttttgtcggtttctccttctggtgaagtggcatccccagtcaggacaatcgtgggagttggactgcaagatactcctgcggcaggaggaccctgccggtttagaacaaaaacacagagttaggcttgggctggtgggacttccagggacaggagccagagcatttattctcacatcatgatgctcagagccatcttgataaggggacaaatgcagtttactctttattcccccagctttattgaggtatagttgacaaataaacattgtatatattcaaggcacacaatgcgatgttttcattaccttgatacaatgttttgatacaatgtgacatattcacggcatacagtgtgatgttttgatgtgaaatgattaccacagtcaggctaactaatatatccaccaactcacatagttacctttttgtgtggtggacaatacttagcaaattccaagtatacaatacattattaactacagtcaccgtgctgtacgttagatccccagaacgtattcacctcataaccaaaatagtaagttgaattctttgaccaacatctccccatttctcccacccccagtcactggcaaccaccattctactctctgtttctgcaagtttgaccttttaagattctacatataagtgagatcatgcagtattgtctttctgtgcctggcttatttcacttagcatagtgtcctgcaggctcacccacattgttgcaaaaggtgagatttccttctttttttaaggatgaataatattcttgtgtgtgtgtgtgtgtgtgtgtgtgtgtgtgtatacagacacaatattttattgtgtatatatttttcacattttttaattcatccattgacagacatttagattgtttccataccttgtctattgtgaatagtgcacacatataggttatttggattactcagaaaacaaaaaaggcagtttctcctttattccccagcaggccctcacctgagcttaacacggtccactattcatgcactaagattagggacactacaagctatccctggttagttctcactagcaatgcaggaaaagaatggtacagagtcctcagattgaggccagcctggctggggaagaatgatggcctggggaaaaggtagtggcacccacacacccctgaggttccacgacagtcctacctttgggtaactttgacatttcagtgatcgtaatttgttagaagactctcctggggttttctcttaggtccttccatcaacttaagagggtgcctgtcattttccttctcctccttcccacccccttgactggcatgtgctgccactgctccctctgtgagcacctgactgcctttgccaaaggcctgcctcctagcgtcccagagcatgttgctgccacctccactattggtgctgcctcccgcagcttcaaagcagtgggtgcccactgtctctattgccactttccctggtgggccaaatccttctagagcccctgcatatgaaatgttttcacctccactagccccactggcggtgggagctgccaatgggctggagcctctggcagagccaggctgtgttcttgagccttcagtgtgcaggtgttggttccctgcaaggtagggaggaggcctgctctccttttgacattatgccttgttgtgaaatgggtctcatacagtgctatctggacttcttacgtcccacaatttttagtgaacccagcttttcccattttcattttcatctcttcccttctttggccccaagcataaggccacatgagctggagaagtctctgggtgagagtccagctggggagcaccatgctgcttctcttgtggaaaggatgcttttatgtggaaacccagagccagatccttgaggagatgttcattgggctctgtgttcttatccgggagcgattcagtgcagaaagctacagtggctgaaggaagaggaggcactcagaatctcccgggacatggaagggaagcttgggcagggacgtgggctgtgtagaagcagaaggaagcagcattgcctattggaagggtcagacaaacctgggctcaaatttcaactactagctatgtgtcgtggacaagttatttaacctctctatgatccatgattataaagtctaactcacaaggttagtgtgaagattaaaaataacattgataaggtacctatgcatgattgacatttttatttatttaatttatttagtttcttcagtgcagtggcacaatcatagctcgttgtagcctctgcctcctgggctcaagtgattgccctggttcagcctcctgagtagttgggactacaggtgtgcaccaccacgcctggctgacttaaaaattttttttttagagacagggtcttactatgttggccaggctggtcttgaacttccagaatcaagcgatcttcccacgtctgcctctgaaggtgctgggattaaaggtgtgagccacgatgccaggccatgattgatattctaaatgtgctaagcatctagcatatgattaatgttttaaataaatgtgtacattactttagatttctttctctttcaacaaacactttatggttatccaccatgtgccaaaagcaacttgagatatgaagagaagaccctaaagggctcgcagtcaagcaagggatacagggaagtaactcataataaatataaggaaacaagggatggaccacattctgtgaaagctcagaggaaggaaaagaaaactctttagtgaggggagttaaagaagactctatagaggagtggacatttgagctaggtcttgaaggatgaataggagcttgcacgacaaagatgttagaggacaggatttggccaaagggaatcgcattagcaaaaggcattactgggaatcagggatttgtcagtgtagctggtgcaggtgcatggactatgacatgtgagataggagaggtcagggctgggggaattgtgaaagtacaataagagattgagccagcttctgaaggacctcgaagctactctaatgagtttggtctttatggttttggagatgggaagccctgaaggttaggcttgagaataacttaactacccaaagggaaatacagaaatgttgacagcagatcatccatgcatccctctattcacactggttgagatgacagaagaggcccagttattagaacatctatcatcccctataggaattctgaggagctccctggtaaataggagctgtgtctccatttggaaacctagagctggccaagagggagtgacaagaagtcagcacgtgcttgtggctgaaaccaagactggctgacctgtcctcatgatcccagagctccagtccctctgaggacacagatacccatccttctgtcaaggactccccctagaagagacacccagggagttttctgaaaagcaacaactcattctctggatagtatgccttgatgggctggtgataagcttgtcctcctgtggctttatccctccgttcctataatggcacaatggccaaaggcctgctctctctcacaggaagattatgcaagtaaaaagaaatgacgaatgtgtatgcactttgataagtgtcatatggtctacaagtacccttgagtcatgattattattaaaatgaatgatggctctattcaaggtgagccagtttttcccatcttttgttcagtgggctcccctggtgggaggccagcaagcagcagaggctggggtttccaggggaccagaagagaagtggaacaatgatctggggccccgaggacatgcagtggaacagtattcacaagggctggggaggttaagaaggggaagcagtgtgtcaaatggcaggtagccagatagagggggcagcaggcagggccaggggcaggtgccaagctaaatgggagagccagggaagaagaaggaatagggagttttctactgtgtgggttttctggtgagtaggaagagctgaagtctttccagaggaatctcttcacatcattaaaaaggagtagcattagcaaaaggcattactgggaatcagggatttgtcagtgtttctggcaggtgtgatctcttggatgtcaattaagcaatcagcatcctctgatgcatattctgagctcagaggtgcaaattagagacccatgtgcctgtttgctagtagtgtttacaagtttttaaattagttatcaacattccataattgtaagaattcacataaaggtctggatagcctgcttttccttaaactgaaagatcaaacaatcttaggcccatatttctgcagagtaaccaggtttgagctatcctaaattggctttcttcagtgatttgtgctccctggccccaaatgcatctgagttactgccctgtgtcatgtagttttcatcctggcctggttttccagagcacaggaggtttgtgcttaaaatctctcccacccacatcatctgggcagcctcatgcctatcaccatgggaacgccaatggaaactctgactgtgcttatagcatgcgcgggcttctttccctggattttattctgactgtgaaaatttgagctctgaaagttgcctttttcatgtctgtcatatttagagaatttctttcttgtatgagtcctctgatgaacaagaagaaatgcattttgtctaaaatatcattttttacatgcattctatcatatggtttccaccaccccttgtggtggggctttacaaattcctggcatgcattgatgaggataagctgtgtctatttaaaggggcaggatgggccaaacatgagctaattccatgttgtattctgaaaaaataattgtggtggtattaggagagttatagcatatatccatttctaacagtttcatatattcaggctgctaaataagtaaaatacatattttattttatttttatgtattgttttgagatggaggctcactctgtctcccaggctggagtgcagtgatatgatcttggctcactgcaacctccgcctcccggtcaagcaattctcatgcctcagcctcccgagtagctgggactacaggcatgcaccaccatgcccagctaatttttgtatttttagtagagatggggtttcaccacattggtcaggctggtctccaactcctggcctaaagtaatctgcctgccttggcctcccaaagtgctgggattacaggcgtgagccaccatgcctggcctttgtttatttttaatcttattgacactatctacttctcaaagcaacttgaagtaaccaacaataaaatataagatataaaaacatgagactatataaatgggggaatgatggatgatttgacaaacataaatatccctagcagacaaggagaacctcatgctcctaacagtctatggttgggagttgtggttaaactatttgccctgaaacctaatgaagccgtgatccacgtggcgcagactctgagaaggctcgccttacggaactgttcaacagaaagaaaaccagcatagaaggaacttcattctttactctcacctctcaaagaacatgaaaggggaacaaatcttcactcccatcctgacctctcctctgcccttttctctttccttaacgattctcacgccccctctctgatgactcttcccctgcttgcctccctgcccagatcctctgtctaccttctttctctttttctcctgctccagcctttactcccccagctccatccagttattttttgtgcagattgtcttcatttgtttgtatgattgactcacaaacatttactgaagagtcttacagagcaaagaccttcttggagaagagaggggcactgggctggcaatgatcagattctgtttggcgtccaagaaagggatgtggtctgtgaacactcccacattattggaccttattctgtccaatcatccggcaaacatttattgaatgcctattgtggccagggtctatgctaaggtctgggaagacaaaggtgaactgagcgggcctctgcaatgcttcccattcattagcatgaaggaatggggagagaaggggaagtaacctccactgctattactaatagtgccctcggtgttgatacctaccaggtaaatgggtacaaggcacgggagtgagctgccttctgataggagctttctctgcttgctggctaatggttacctgaagcaaagctctcctgactgtaggcatctcactggggaggaggaccatggcagaggtgcccatacaaaaaggcagaaacaagccatgggtggcaagtgccaagcaggtaaccgcagacactcacaattccaagtggcttacaaagcaggaagcataaagcgattaggaggaaatcctctaatcccttgatggaacatcctggaaggttcttcacacttgccttctaatgtgtgcaaaatacacaactcataaaatcatagtgttctttccctcatcagctgacagaatcgttgagcaagctctgggcaacttctccttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggcaggccttcaagaaagcttgggagagcagtaagaccaaatagcgttggccagacaacctactggcttaggggcttcagggcctcaggctcagaagccacactaccttatggtatactttttagctggataaccttgggcaagttaccttgcctctctgtgcctcagttacctaatctataatggaactatctcacagggtagttataagaattaaacaagttgatatagaaataggatttctggataaagcacaggatgccccagttatatttgaatttcaaatgtacaacagataatttttagtatgtgtgtctcaaatattccatggacataactgtattctctctctctctctcgactgaatcttgctatgtgcccaggctggtctcaaatttctgggctcaggtgatcctctcacctgagtagctgggactgcaggtgtgagccaccatgtacagcatataatcatattttcattttccaaatctggcagccctagatggcaagcctgtggaagtgcacctagcactgagcaaatgctcactaagcattagatgttatgttcccttattattcccttcgggattgaattaatgactttggcatttggttttgaaaagatggttgctcttagttctgggtctcctcaaccatctggagttaaattgggagagcccagccactgtggtcacggcgcaatggagcatctctcctggggcatctgaccacataagcccaagtgatcaaggacccaccaccaaggccaccttcacccggctccactccctctcaccctctgcctctcaaaccaatcaatgccctttgtgggttacagacatggaagcacagaaacaaacatggctagagggaattggcagttactcaggcccactgtgtggtgggccctgtcccagacccccctcgtgttttctcaccgaatcctcccagaaactcagtgggtaaacctgaggacaccacctacaaattgggggtgataatgcctcccaaactcatagaattgtgaagaggaaacgagaagatgaaagtgaaggccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctcccctggttcctggtgccctgctggcctctgacactcttattcttccaagctgcactctccttcacagaaggtacctcttcctccaggaagccctcaaaccagcacaaggctgaacacacagctggagaaaaggacagcatgggcagaggatgcccttggctcactgcccttctcactcctccatgggcccagcctccctgggggtccatttcccttccctggaatcagccaagcactgagggctgggtcatctcccagcaagctcaccctctaataagccagcaggccacattttgttctccttaaataaatcttatagaaacatttaaatgtttatttcactcatagattctcaggaatgcacaatagttttcctaaccgcctgggcacagggataaatataggccagtgtcatagatgggaatattagcttcctttccccagagtcacatggctaggcccaggctaggaaactgtaaggaacacccccagccccagctccagcccactccagctcaggcaggcatggggggtttagatcctgtagatgggcgctggcagacagcccaggagaggaggaccctgctggaaggcaatgtgggctagtgaagaagtcgggtaggcctagaccagaatcccacctgggtgaccttgggcaagttactagttactaaacttctctttcatggtctaaaacattacatagagctaataatcactattctctaggcttgttttaagtattaaatgagagaaagcaataataatgacggtgaaagtggtggtggtgggtgcgtgctgtgagactgtatccccagatccctgtcttgtagcctggagggcaaacagggactgccttggtagagaggagatccagcagcaaaagcagccagtgctcttacaacaggataaaaggactctctgggccgggcacggtggctcacgcctgtaatcccagcactttgggaggccgaggcatggcctcggtggatcacaaggtcaggagatcgagaccatcttggctaacacagtgaaaccccgtctctactaaaaatacaaaagcaaaattagccgggcatggtggcgggcacctgtagtcccagctactcgggaagctgaggcgggagaatggcgtgaacccaggaggcggagcttacagtgagcctgatcgtgccactgcactcctccagcctgggcgacagagtgagactccgtctcaaaaaaaaaaaaaaaaaaaaaaaggactctctggggacttgaaagaaaatgattatcccagcggcaagtcctaggggcacaggagagagcagaagtgcctctgctgagttctgctggacatggggctcctccctgccaagcatagagggccagttccctggctccccaaaggctccccggtgtcttccctataggccctcccttgcaccaagggcctgctctgcctctggtggatcctctttcctgccattgtccatttatttctagaagtcagatataaagaacaactgccttgttcatcactgtttttactctcatgccaacagactctgggagtgtggaaaagcacacaatatatgttagctttattccaaggagagtaactcagctagtcgttcatccgtcatatctactatcctcccttccttcctcccttcctaacactactccaccctccatttcttctgccttttaatgcagtcatttagtcatctagccagccaattatctacccaacctatcacaacacaatcaagcatccatccacctttccatccatccatccctccctccctccctaagctccgaccgcatgctggagcctatgcttatgggtggagatacacatgtgaaaggcacagtctgtggcccgcaagtagctcacacatagcctgatgtgtggagacagaaaaacaaagaacagcaatctgtttcattgctcacaataggaactaagggaaaacaatttttatatgcatttccgactgtctgtaaccgtcaacatttctaaaacactttctgccttgttttaggcacttccacgctaaattctcacagctcttaccctgtgaccagaaccactagaggccagcctggtggaactgtcctcttgagctcttttttataatgatggagcatcaagcacctgtttcccatgcatggggcctctggtgtcctagctagggccaggaaaggaaggaaaacctggcaggatgacatcagtgggaaacttgagtttgaatctctatttgaccacagcacagctaggtgatctttgacaattacataaactctcagagactccatttcttcatctaaaaaatagagataataatatctaccttggagggattagaccacataccaggtgcccagtagttgctaccattatcttgtataccagatactaatattttattgataatttattttaaattattttattgaaggccttaattgaggctgttcttgcaaaggatgtgatgagataagtagaaatgaactcagagaagatgaattcaaaatcctcgatgggagcatccaagtacttcctggtttctggtgagtatagtgcccttacctgcctgttttctcatctataaagtgggatagccatcatgcctgtgtcttggagttgtcgtgaggttgctatgtgtaaagtgcctagagcagtgcctggcacatgggaggtaccgtatgagggttctcactggggaagctggggggcagggggatccctactctacacagtccttaccaggttccaagtgttttacatgctttatctggttcctcttcatctcattcctgacagataattgatcctttgggtcacacaccttttctctagtcgggcagcacacggttcccaaggagtttccagggaggtacaggcagaacctctctgttggccagtgaggacagggcttgaacagccaaaaggagtcaaatggatagagaagctggcaatctgccttcagcagtaaagtatatggctaaactcgagatattcccatagacagcgcagaacaagtctcctccaggtcctgatgggagaaggccgtgggagaacacaagagcaaattggatctgacagaactggcatttggtagtaaatctaccaggaagtgagcttcctgagagcaggaccttagttagttaatgctcaataaacatttattgagcaaattcaataaacattgactgagtaaatgtacttcaattcctcgattccatatttattgagtgcctaccatgtgtatgtgaataatcatcccttgcctctgtgctcaaactctattgcatataatggggtatttttggaatagaaataggaaaacaattaattatagcccatttcctcagcttacaaccatgagacagtggaatccgggccttgctatttccctattatgtgattttcagcaactggcttaacctttccaagcctcagtatcctgatctgtgaaatgtgcatagtcatcactaccatgtacgactgcgttctgaaggttaaatgctagaaaacactaggaacctgtgtgttagtttctttcccttcatctggataagatacctaactgctctaaattcgcactttcatgggggtgactctctctgctctgtctacctcacagtggttttgcacttgcaatgtcattgcacttgcagtgacacatgtggaaactttttgcaaaccgttttgtgctatagggactgagcgcctattgtgagctaagtactttgctcatcactttatatatattattccagtaattaaagtcaagctgcctgggtttgaatttagcctcaaccacttccttagctatgtcacccactgcacattacttttctgtgcttaaattctttatctgttactggaaatactaatagttttcccaggagtattgcgagaattaaatgagataatgtaacatataaaacaagcctaatatggtacctggcacatagtaagttctccataaaggttagctgttgttagtggctattcctataactcttagtttctagatgaggaaactggggcaaggaataatgaggaatcacttatccaaggtagcagtcaaggatgtgaagcccaagttcttcctgctctgccatgctgcttataccttacatttctatgagcctttcctgtaccttctggaactccctggctgcttggtcatcctcctcttcttaaaggacagacaggttggctctgagcccagcccactgactgagggtgtaagccaggataggcctcctacaacccttgtccactgtttttactctcatgccaacagactttgggagtgtggaaaaacacagtatgtgttagctttattccaaggagagtaactcagctagtcattcatccatcatatctactatcctcccttccttcctcccttcctaacattagccctccctccatttcttctgccctttagtgcagtcatttaatcatctagccagccaattatctacccaaccccagatttgttatggtggcacttacatcagtccctatttctgagccaaaacaggaggaaggccagcacctccatagccagaggttctaggtgctccacaagcagatcccttcctataagggccacacaaacaagactgcttctccagagcacactccaaccacatctcagttacttaaaagttacgggaggggaggggtgcagatgccactcatcagtggagtgctgcagtgaccttaagtcacaagagctactgcgtaacagggctgagcatccatgtctgcctagagcatcaacgaatgaaacacaaagtggatgctcggagagacccagagtgcctcatgcatgtggcctaaaccaggcaatagcatggtggcctgtgtttctaggagttaatgtgcccttccccttcctcaatgtgtccatgtcccttcctcattctccttcagctaagcaatcagacagcccactcaagttaaagttgggctgtttgattacctgactgaaggagaatgaggaaggggcatagacaggcatgtgacatgcagctttggttgctggccccacgagcttgtgctcctgaggggctggcaggcagaaggggtttggtggtgctttggcattcccctgacagcgagctctgaagttggcccttctgaggtgagtggctttgggaacacaggacaacgtactgttggcccaggtcccagagctctcactgaggacccaggggcagtaacagtgctcagtgcgggtatggactaagcatgggctttggggtcaggctgcctgggcccagatcctgggcctgccacttatgagctgtatgaccttggaggaaggtagttaatttctttgtgcctcagtttcctcagctatgaaatgggaatgataatacctaccgtaaggctaattatatgttaaatgagttaatatggtagacgagtatctggcacagggttagctattattattaagtggctttgtgtgcagcggaggtaggggaacaggggaggtggtagctgggtgctggaatgggtgatatgaagaggtgaagtctgcttatgagttcacactgacctgcccctgggggcttctaaaaccctttggaggaggatgggagttgttcaggtggaagctagagccggtgaaaattgggctcttacagctaacatgagcctctttgtaccctcaggtttacaaggcacttcagaggatgctgcactgtctgggtgagtcagcttcctactgtggctgctggtcacagtccaggaactcatctaggcctaggtaagattgcatctggagcctggggccaggtctggggccctacagtaaggcggagatgggctggtatgtgtcctgagcggaggttaggaaggctctgaacactgtcatgggagcaaagactgaagaaactagagaaaaagagactctgagaagactcagaactgcctttctgcatctgtaggatttcaccccactataggttgtatggagggcagaaccgagggagagtcttgggggaggcagattccagcctgaccaggacagagctggccaaccagtgcacaggcttccttgggaggcggtgagcttttcattatagaaatattcctacagattcctaccctgggcccggtggctcacgcctgtaatcccagcactttgggaggccgaggtgggcagatcacttgaggccaggagtttgagaccagcctggccaacacggcgaaaccccatatctactaaaaatacaaaaattagccaggcgtggtggtgcaggcctgtagtcccggctattcgggaggctgaggcacaagaatcatttgaacctgggagacagaggttgcagtgagctgagatcacaccaatgcactccagcctgggtgacaaagcaagactctgtctcaaaaatacaaagatatattcctacagattcctaagacctacctcaagagattccaattcagtaggtcttggatggctgaggaatctggtgttcaaaaaattcccagggtgactgagtggggctcacgttatagagagctttgcctgcctgggcggagcttagatgtgacctgggattcttctagcactggcagtctgtcattctgtggtcccctcaggtcccaggcttgtgttctgacagcttctattcctgctagaaccccttggctacaaactcttccctttgagtctctccctgttcaagggccaatgcagaaaaccccactcaggacatagccttacaaagtgcattgttggggggctttttgtggtatttgattgcagcttctgattaaggacctgaagagtacgtctgtctgtgcatgcctgtgtatctgcgtgtgtgtctgtgtgtgtgtatgcgtgtgtacgtgcagaaagagaaacaggatctagtcctacagattttgtgtttgtgtgtgagaaggcctcggctagtgctcatgccagtgatgggaaataggggctgggacctgaggaatcacaactagggctggaccccggggagctgtaaacttagaaggatgctctgttctttgcctgcttcacagactgggaattcaggcaggattgggacttccagccgagtcatcctggccaaccccgcttccttggctgcctggcctcggatgctcccagggactcaggttccagccccctgaaggctccaggccagctcctgaggcctgaccctcccgaggccgtgactacctgagaaacccaatgtgggtggtctggtgggtgcaatagtgggagaagcactttactcaccatgcctggttgccttctgaaaagctttgaaatgtccagggcgtggcagtaagggaagagggtaaaagaaagttgagtttgatgtggcctttggttgggggggtctgaactgccccagcttcatggtccctcaggctatagaaggcacttgagggctgggctgaacaggcagagtctaggaggcagcaactaacccttgtactgggtaacacataagaaaccagcagcacagcaaagttaacagacttggtctcaaagtttcttggccaagacaaggtctcttgaccagaatgtagaggagctgggattgaagcccagcttggtatgactgcacagtttacattcttaaatcctgtgctaggtatcctccctgataggacctgggcttctcggctcccggctcccctgaattcctgctggccttcctaaccatcacagcttcaaaatgcatataggtacagtgccattaggttggcatgatgaatttctagaggttgccacaatggggggagggttccatgagcttgcctgccacaaagttgagagtaagcgatccctgattggctagtgggagctccaaattccagttccccacaagttcagtctccctgtgaccctgagccagaaccagactcttattaaataacggatggtctctgaaggcccttcaagtgccatgattctctctgtgcccatgggaaatcaagactatagagagaatgtttgcaggtactgatagcttctgcattattggggcccagcagaaggacccatgagggaagaatgcatgagtgaacattatttttacaaatgggtagattcttagtgaatattctcatgttatgattacatttgttttcttacacattacaactctgggaacttaagtaacaaacactttaaaaagaatggccctttggatctccatatcccaaacccatgggatcaagatgttgtagaacttggcagtcttgtgggtggggagatgcccttcccttgaatgtctaagtgacaggtgtctatgttgtcttgttttatgtttcctgaggatatactctgaaagaacttttaattataaagcattgtaagcaggaagaatttaatataaaagcctgtcttcactgacagcaggggtgcatctttgctgatcttttattatcttatattttaggaatgcttttagtcttggggcagctgtttgggggagttgcccaggatttaagagctacattttgcctgagaatctgattcaagggtactaccattgttagtaaagtagaaggggccagggatggccattttcagaggagtccagggcgaggaaatagggatgctaaggagacagaggccaagaaagtcatggcctgagggtctggaagcagtcgcatttgaatgcagttgtgagtgttttgtctctcctttccttaatccccaagcttttggaacttggcaccctcagcagcaggacccactatttcccagaatgggggcctggacttgataaaaccctgggctgggctgcctgaggctgaagggctagggggttggcccactgtcacttagacattcaagggaaggacaaccccctcacccctaaggctgccaagttctgcaacatcttaatccgatgagcttgggatatgcagatacaaagggccattcttttctaagtgtttactatctaagttcccagagtcgtaatgtgtcagaaaacaaatgccatcataacatgaaaatactcactaagaatctgcccttttgtaaaaataatgctccacttatagattcttccctcacttaaaaagcgtctatcccacctggctcaggtcagtttggatgactgtccgatataacaggacaataccatttcaatgcaaatcaactgcaaagttcatgaagtcaaagaaaacagtgatggagaattttacatgcaaggtctttgaccaaggagatcagatagagcttatcaattaagtgaagaaaatacgacgaggatgatgctcaaataggttcttcaaaagggaataatttgaatatcgagggactgaaagagatccttggggaaatggatgaagcccttaagtattaaacagacgtagactcttaattaggtgctgtaaagtaaaatgtgaagagcgagttactatgtgaacagatcactttgctggtataataaataaatatacccacaccaaaatcaacattttattctttcttcaatctgaaaattagcacataacctatattttgtaatctgtatagctaaaaatagcttgttttgaatgcctcatttgtacaataaaaatcttgatgtctctttaaattaatctgctttcatcatttcctttctataataaaatttcactgaaaaccttttttgctatttactatacaattttgatctccattttaagtggattcactttaagtggccttttctcgtgcccactcacctgacataagaggttctcagtgctaatggttctcatataagtccttctccggtttcagagggagcctgcatggtttgtggtttgacttctgaggcctcagtcagacacagcctagatggttggttctatacccagaatatttggggcctcggtcaattcaaaccaactcagagtaattgattcctcagtatggaagccacacaccttctccaggtacccactgcaacctacatgagctgtcagcaaaccctctggccagcctaaaagctgtggcctcagcccagggtgcttggcttggcccccagccaggctagctgagggcagggagggggcacttacttggccggcagggctctgggctgcctgtggctctccggggggctcctcgtcctcgggaatgtggggcatggcagcctcctgctgggagtggccacgtgtgcccggaacctccgctgcgtcagccccaaagatgctccaagaggcctgggctccacaggctggggagatgccaaaaggacaagtcaaatccattcccatccctgtcccaagctgggttccatttcccggagccacaagccacagtgagagccggcttgagtttgcatcaacaccggag

SEQ ID NO: 945 - DNA, 120898 bp, Homo sapiens
gaggtttggaaatgtgcttttattttcaaactcaggtatgtgacactctacagttcaatgctagcacacctgtgtgaggcttaacaacatgaggaactgatagccagtgatacacaaatccagcacttcctctccatttactctgtcaggctgtatatggggagcaacacatatggctttgtggcagccagaaagtgaaggtctttttaggaggtgacatcaacaatgacacaaacacatcactctgcaactgaaggcagggaaccagactcctagggctaagcagagatgtcagacttcagaggcatttgggggactcttcagatccacatcctcactgaaaatccagggcctgtttctctccagttcactaccgcttgggcagcagctcccactgcttcaggctggtctttgctttccagaaaagatggactcatgagcactttttcagcccctgtatatatggctattcttatgctcccttttggagatgtccttttcctcgacctcccttgcttacaaatggaatagggtgggagagggcctgtgcctggaagtactcttgcaggcttttctgtggggcagctggaggtgcaggagctctccataactgccttcctggcctttgactcatccagaaacaaaggtaggaaacttgtgaccaagtgaacaatggggccagctgagcctggccctgctttaagggaggcagagattgaacattccccacctggagttctgcttccacggccactctctagaactctatttgcatcctgtctttggctctgagggcctcatgtagctaaagctccttcagttgtatccagaccccctggaagaggccgggcaaatcatccacttctgcccccagagtccctctgccctgctctgtaactctttaccttaatggcacatccttgatcaaccctggcttgggcctcagtcattttctagctactgtaaaggatgcccccttcaataaacatgctattttaaagtggggcatgcttggggtggggggtctctctgaaggagtgactgcattgagcccagtccttgagcttggcaatggtgttgctagtctggtctcattcctgctctctcacagagtagactgaaaaacagaataagctgaggttaagaaagatgttgctttttgcattgtgatggtgctggtactgagaagcatgcagcatgtcagctgtccccaggctgctctccaccaccttaaatgtttgcttgttcttttgagcaacatttaatgacaccctcccaagcgtcagccaccatgctaggcacttacccaagagatgggtaagacatggttcttgtctttgaggaaaaatgctaggggagatggatacataaataggccatggtatactataggtaaaggtcaataataataatgtttaaaacgtgccagaaagcacagaggagtgtgtgacctattatgttgtgtctggtgaggagtatggaaggaaggtcatcaaagctggtatggaggggataatttttgcactcggtcgagaagagtgacctgaagaaaagagaagaacagctggaaaaaaaactagtgagtggaggtccagcactatgagagaaactgtttagttggggagccagagatggagtagctgatgggccacttgggggaatgagactgaaatgtgaggcttccagctaggagaccatcagaagagtcaaggagagcacagctctggagccagcctaccctggggttgagctccagccccatgatttactaccggggtgtccttgtcaagttacttgttctttttgtgcttcagtttccttatttgaaaatgggaagggtaatatccacttcgtatttttttttctttttcttcaggacttaaatgaattcatacctatgtaatactgagaacagtgcttggctcatagtaagtcgtatatgagttttagcaatgaaagcaaacaatatcaataacaaaacaaaaatgcaaaacaatgacaacaaaacccacatggaaatcaaacctctacaaaactgatgaaggcagtggctgtaaaagtggggagagaagtcaaaatggagaggggatgtgctccttcagtgttgtgctaaataactggggatgctctgaaacacccctaattatactggggttggaaaccccatttgaactgaagcactgaggtgcaagtttactcttgcatgtggtcacacacagagtaagagactgaagcagaaagcacatcttctctcctcattcacctgtgaggtgggttaactgttttcaaagagagaatagggaatagattgtgctgtacagcagctcagagttggcatttgaaatggagactagtaagtctgccattgaagccatgagttttctgtgtttttaaaacatcttcaatccatgtggacagctcattgaacaggtgcctggtgactgccccacactggtgaaaatctgtgggttggcttggcatgcatcttatttatccagaggtacacacccagagcacacttttgaagggttgttggctctgtgcacaggcatgttgtgtgtgtgtacacaacagtatgtgtgtatgtgtggacagatgcgtatataataattcatatcttcccatttcaagcactgagctaaattcagcctatacttttttttttttttctgagaagcctttcctacttctgtaaaaagaaactctcattccaaaggaaagaatgggaggctgaagttattgaaaatgagatgggaaatgggaagatagtcactttgcaactccaaattccaggtctgatgcttagggtgttagtcattaagcaaattcttcctgataaccaattacagagaggaaaaaagagagtaagttttttactgccccctacctcctcctcccccgtgccccgctccttacccccaaccaccagtgaaggtgttttagttctccccagccacctgagctaggggcaggagaccttcccttccaatagagttccttggtgaaggtgacttcttcatccactggatgctttcccagggcagttttgttgatcctccaagaacatcaagtcactgtgtatgaatagctcccacagaagtgccgagtgttaaaagaacccttcctcatgacctgatgggatgggcggcagtgtgtccacacttgggcctgacgttatacttggggaaagggtggtagtctgagtgtctcagagcagggcactggctaggtgtgaggtttcctactgctctgtaggctgctcatgctggagtcctgagctccaccaggagtccctctgggctgccgagcaagtggatcttccaaggggcccatcagcctgctctgcacaagagttataggaattgtagagccccagcacaacagtcaagaccagcatcactgcagccatcatccagatcacttgccagtgctgacacagtttgggatacatgacttgtaagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttatctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctcaagagttcacttcaaaccatccaagagcaggcagaagattagaagcctctagcaatgtctgggtggtttgttcatgatgttatctcaacctcattaatatttattctctaatttctccctcttcctcctcttcttccttcactctctccacacttctttctctatccctttcatctctctcttcctctccatttttgccccttttccctcttgattccttcccaactgtctttcattttgtcctctctctctctctgtggtgtggtaaaaagacaccgggcagatggcctgctttgacaagttcattctagagctctctgaagaagccctgagccccttcattaagccaggatttcctgatgtttttaacctctaacccaatttaaaaaataatatgaaaaatgagaatactgaggattcctgaaccaaggaggtggggaaagtgatagaagtgctttctgaagatcctgaggctcatacacacacagcaatgaccaagccattggctgagaagcggagagctcaaattttgaggtagcagaaaatgcatgactaacaaaggattgacagactcaataaatgccctccttagaaagggaccagatgctcagaatgcctgccttggatgctagggccacagagaacattgacaggtttccgttccatgcgggaaccccatcagatcatttcagtcacaattaaggaaagcacgaaagtgaacacattcgctgatttgaaaatcattgactattttcacaactgttgggaaggcagggtttagaagtagaaggttattttctctcagccctttgtagattctctagattctatttagacagagttggatgctaaaatggagcctttggggctgtatttccatcctccaaaacaaggtgccagagtggcttctccctactctaaccccactcttaagtgtggctctggaggaagagaccaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggtttacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggactgagaaatatcagcagagaaccctcaggagggagatgaggcctaaggagaacaggatctggttgcttggagtagggattgcactttaattgttaaacttggaggttctttcactggggagacagtgtgtgatttgttttcagtggagaagcatttctccagttctcctaacggctcttcccctgaacaatggggtcgaccagcatgggctgagacctctgactttagttgaattctccaccaactgggctctattgatagctcctgtgtgcctatccattttgcttctaatcttcacttcattacctatttgttgcatgcatgtggtttccagagttttccagcaatgaggcacagatacatacccagattagataatatttcagcagctgattagatattttgtctggagctgccctggaccccaagatatcccaggggtctaaaaatagattttggtgaaggttttccaaggtggctattactacattttaaaaaatcaaaattcaagacttgtggtttaactatactaatagagacaacatagctgaatatatgaaattgggctgtcctgaaaatccagaatgttggcatggttattatatctgtggggtagagtaacacctcatctatgggtgctagtttatcctatccctaagcgtgaacttctaggggataattcaggccaggtggggctgagacctcattcctataatacttcattgcatggagtgccctggaactaaattaggtcatttctacgattctgcatcctaaaggccaggcaggaaccacaagtgggacaagatacaggtctatattctctttatctacatgttatattctccttccccaacttaggggaaagtacctttgaaataggaagtattttaaaagaaaaccccaagtatttccaacctaaagtgaagaccaagcttgattggtcagcatggtaggcacctgctggagactcacctttgccactgagctgagtttgccctctattccgtgtgtcctccctgtccctgttcttgtaagaaactcactccagggcttcgagtcaactctctttgtcttgggcctcttcatggggatggctacccataatttcatctgggaaatgagctaaccatggctgggctgggagggactccattcagggcccttcgcccttccttagctcctggagctcttgattgccatcctcccttcccatgactgcccctgacctctcaagctcttgcaaacttctcattgctagctatcttggctctttgggatttcctctacctccttcccaacatgtgtgccctcttggtttcttgggctactcactggggccccagattcactgctgccctggactggcatttccagggattttgtgcatttaaattagatgaattgtaacccccatttcagcaacggcaaggactccaaacacaggcttcccacctgcttcttgggcccttttcctcttcctcagtttcttctacctcttcaggttcctcaggactctcactcttctgttcttcctcctcctccttcaggtcttgaagttctttggtcttctttagaccttcttggaatctggggggcaaaaaggaacagttgagtctggaaagggcagatgcagtgcatcctttcctgagttcctaggggaggggacttgagcagcacctccaataattatgtgcttcctatggttccacaaaacaggaaaaagctgggaagctccactgaatcctaaggcagctcacgccagtaccatttcccctcactcctcagtcatccttcctgtttatgtgaaagtgtgacaaaactgacagggaaaaaatgtggtgcagggtctcctgactgggttcttaacccacaaaacattccgtagggctaagattgtatttgttctccatgtgaccgtggagcttcagcctctcatctgtaaaagagagagggtgacactcatttcacagggcgttggaatgatttttgcaagtgccaggcacatggcttgatctagagaggtactcagtaaatgtttacgaaaccaatgaaggagttcatgcccataaattccaaggatagagcacagtggtgggtgagaaaggcacgctttcaaagagaaacccttgtggtttttctcccccagggtcaatattaccccaaacatactctgttcacttgtcctatgctgagtgtctaacactagcagtttggctgggcaaacccaccactgaagcccatgggttctgtgccagtgggaagctatgtcttcctcatgagctatggagacaggagacgcatagggcaccatacatggttggaggtgattctctaccttgaggcttggtacctgctcaggacttggtctctccagtgctgacaactggccatgggtgctattgaagctcaaatggaggaggaggcagttcgaagttgaagagactccatttataggaggaaggagtgaccaaagcagttctagggagcagagctgcagctgctcctgggcactgctggcagcaacatgactgctttgagcacgtgtcaggaagcctcaggcaccaccaagaggaacccatccaggacccctgatttccagactattctgagcggtggcattctggtggctctctgcctaaaaagagggcagtcttgttattgtctaaccacaccctctgaccctgcttcctcctgtccttcctgtggaacagtcttgctctttcctatgtagttccttcctgtggcaaggaggtcctgcggccactggttacttccctaaagcctctaagaaacaagaaagacccatgggaaggcatcttctgagaactgccaggtgcccttggggtggctgaggtctgactcaccccttgctgtaggcttcttcctccatcctggccttggtctcctgactaagctcctccaggcagctcagggtcagcgcaggagcagaggcttcacaatctgggtccccatttgtctttccactagtgagaagagggaagtacagggcatcatttcagaaaaaggtggaggcctaaaaacaaaaccatgtttttggcccgattcctgattaggagtgaggaaactcaggctttttcagtaactttcagattttttcccaatccttctaccctgagacaagattttataaaggtcctagtccatgaattttccccagcccattaaatacctcaccagctccccttctcctcatgctcccaaactggcgtttattcttattccaggagatgctgtaatgggtgatctacagcgctgagatgaggaaaatgggggcagaccagcacgtttaaggtcattccattcctgttgtctatctttcacctgaagacccccactcatcttttcaaatatccactcagcatgactaagccacaggcacattgtaatgtgctgggggcacattagaaaataaagaaatggtttttaccaacatggaacttagcagaaggaaaagccccaaaaaaggaaagaaaaaatatgtgattaattacaaataataacttttatgaaagaaattctgtacagtgacagaaaataacaaggagagaatgtgtttagagtgaatagttagaaaaggcctctctgaggtgctgaagttgaagcacaggcctgaaggatgagaagtcagatgtattaatagcagaggagagggttgggtgtggtggctcatgcttgtaatcccagcactttgggaggccaaggcgggcggatcacctgagatcaggagttcgagaccagcctggccaacatggtgaaaccccatctctactaaaaatacaaaaattagccaggtgtggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagatgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaaggcggaagagtaaacagtgccacacacttctgagtttgaagcgtgcagacaaggtgactattagatttgataatacagaggtcaacaggagcctctgtgtaatgttgggagccaagcacaggtttaaagtaaagaaggggaggttggaaaggggaagccacagacacagcaattcgagtaggaaggagagtagaggggtgtgttggagggagtgtgcagctgaagtaggtcaagggaggatgcacatttgaatgtaggtagaaatgatccagtagaggatgagagaaagggatgcccgaaggaactcagtctttgcaaaaggaaatagggacagaccttggaaaactagagaatctctccttgtttgtaacaaaggtaagatgatgatgaagttgttgggctggagatctggtgaaggaaagtgagagggctcctatgggaatgtagcttaggtattctctataaagtggaaggcaaggtcatctgctgagagtgagaggtagaggggtctaggaaggtctgtggagagaggaggggtgtaaaagagttatatgagaaagaaggaaaacagacatactagaacatcttggtaagatggctgggaggtgctgggagatcattgcaggtatgggatcacaagtttaaaggaagtatccagatggctatgctttccctagaaatcctgcagcccaccttcatgtcctgattcccaatgggagcaatgtcgtcatggaggagtcctccaacaaggcaacactgtgagcagagctttccagccaggactctgaaagatcacagctgccaccctccctgaactctcagacagggtttatgagtgagccttgtatcttctcctcattcttggcatcagtttcccatctcttagttttcctcagaccttttaaaatttacatttagtcaggctggaaaccacaacccattgtgaacaagaaagataacgctctaaaaataccagctgttcataacatttctccttttgcaaattacattatccactcccttccatgtgaccttggcctaatgtgcagtttcctatttatccaaacgactggagcaagaggagaaaaacatagctacagccaagggcagggaaagtaattctttcatgaaatatatatatatatatatatatatatatatatatatatgaaatgagatattggtatcagacttttgatttatatacaactgtcagccttagaggttccttaatgttaagcatgcgtgaaggaggacagtgtagtataaaggaaaagaactcgcctgaggcaaacttggattcaaataccagctccaaaacatgcaaattatttaatcttcctgaacttcagattcctcaactgtacaatggggatagtaatacatacctgatggtggaggtgtaagaattaatgaagaaatgtcaataaactttctggaatatggcactcaacaaattatatctgctattattattgttatatagtaaatgtattggtacattttgggagcaatctgagctacctccaaatatgactcataaaaaatccaggcaattatttatatcatcaagggagagcttgttatatattactgagacacttcagagtcagaggaaccctaaatgtgaactaatttaaggtatggtaaattaacattacattttcataaaatggctttaggaactttctcaggtgcatgtctattgtgtgtcatcacacattatgcaccttagaattttgcagataagtgactgtaaacaaagctctcattgtccttgggtcactgatctctagagaggaaaacttttccctagcagggccaggaagcccatttcatcgactcttttacatgcagatcttctgttcatttcagctcccctatagggctctcatatacattctctcacttgatctttccaatgataagaagagctaaacattaacttatatgtatcaggctgtggtctaacatctcatttaaggctcacaaatgacccaagaaggtattagtgttctctgtttgacagatgaggaaaccaaggctcaaaaagtaggctgaggcatgagaatcgcatttcaagtgatttcatatctgtcaaacagagaacagtaataccttcttgggtcatttgtgagccttaaatgagatgttagaacagagcctgataagtaagttaacttttagctcttcttatcattggaaagatcaagtgagagaatgtgtatgatctcgggaccagcccaagatcatacaaccagtgtgtggtagagctcaaattttaccctgtgcagtctgatatgtgcccattcttctgactgcactatctgccacctaggtggggtattatcccatttcacagataagaaacccaagctcaggttgattaagtgacttgcctaaattcacgttattggtgctgggactctcaccttggtcttctacctgtgtgtcaagatggactttccagccctccatgaacccccgcttttctttcaatagaagccttccatgaacccccacctttctttcaatagaagccctccatgaacccccacctttctttcaatagaagccctccatgaatccccctgcctttctttcaacagaagtctcttcctttcactctgctgagtgaagcccttcctgccctcaggctggaccatggcttccatgctgcccctcttttcaaggctgcttgtctacagtgtaagtggctgggagggcctttgtttactgtgtgtgtgtgtggagggtgggtaggggggagtggaggggttgtgggtagggtggcaagtgggggaaacacaacatgtaaaatgtttgctgttctctcctgacctctaaactgagcttgtagtttcctaaatatcttctctaactatctggaagtttctctctaagcatctttaagactaagctcaaatgccttctcctctgtgaaacctttgctggtgttctcccctcccccacaccctctggttaaagttgatctctcctttttttttttttttccttgagacagggtcccgctctgtcactcaggctggagtgcagtggcatgatctgggcacactgcaacctccacctcccaggttcaagcgattctcctgcctcagcctcccaagtagctgagattacaggcgtgcaccatcacgcctggctaatatttgcatttttagtagaaatggggtttcaccatgttggccaggctggtctcgaactcctggcctcaagtgatccacctgcctcggcctcccaaagtgctggggttacaggcatgagccaccgcacctggccctctctctccctttatgctgccaccgcacctctgtgacagcatgactcacagggaggcattgatgtatgttttagatacctgcatatgactgtcatcacaggaagaaggactgtgtttgggtcagaatagtgcctggcatacagtaggtgcctttaagtgcctgtcaagttgcatcggtttcactatgacttatccagtccctactaggaatgttgtaaaaggcacaagtcctctctgtaaatggttatttcctgagaacccagtgtttgggttggactaaacgaatctgtaatcatggctataaactggagctgagcacagcctgtgcccaccctagggatttctggcccgaaggctcatggatcttggcatctgtcccctgcctgaaatcctatgtgctttctttctgggatgattcatgaaaatgaggctcattattctcacacgtgcaccaggtcaaaaatgtttgtcattgtgctcagctctcagtaatgtgaagaactatttagtcaaaatatatttttggacaggcaggtatattagattcaacttttcccacatggtaaacaatatttgaaagtggctactatcctttgtgatcggcatatcttcttgggctcagcaatatttccaagtcacccccactgccatggttccctctgacaagcccagcccagggaacccaagcttccttactccgtgttactcagttctagatacctggggtccgccacaagtttattggggtgggtggcgggagggaggaattcactccaagataccatcagcaaaggggagttgcttactgtacaaatttagtgtcctgtgaaatctttaaggaatttaccctgggtgcttcaagagtatagaaacatggttatttttagagattcagagttaaaattgctctgtgatacattaacataataacccctttttgacactaaccctgtgcatcatctacatcctggttttgctgatcgctctgtgaacggttccacacacaccctgtctctcaccccgactctgttctccactccatgcccaaccggtcaccatgctctttcaaaaatagctcttaaattcatcctcttctctatggtcacactgaacttcgttttgttcttccagttgggcggtctattaaaagggtaagggcatgtgctctgctatctaccagctgtgtaacctcaggcaagtgacgatttctctgagcttcagtttcctcatctataaaacagagatattaatagtacacctacctcatggaattactgtgaggattaactgagattattaatacaaagcaattagcaaagcacttggcatacagcgaggtgcagcaaatagttaacagtaattaccattgtcatcagtgcagtagttaacagtaattaccattgtcatcagtgcagtaaatagttaacagtaattaccattgtcatcagtgctgtaaatagtcaacagtaattaccattgtcatcgttatcattatcatcattccttgaatactccatactttgtcacatggacaaagcctggaatgttgttaacctcctgttcacctagttgattatgtaccctttagatttttactttaaaagtaagttcctagagggaaacttttttttttttgttttttgagacagggtctggttctgtcgctcaggctccaggctgcagtgcagtggtgcaatctcagctcactgaaacttctcccggctggggtcaagccatcctcccacctcagcctcctgagtagctgggactacaggtggacgccaccacgcctggctaatttttatattttttgtagagatggggctttcgttatattgcccaggctggtcttcaactcttgagctcaagtcatccacttgccttggcctcccaaagtgctggggttacaggcgtgagccactgcccagccaaggggaatcattttctaagctctctcttccccccacttccccagttcccccaaccttacaccaaaatcaggttaggtgctcattttctgtgcatcattcccttagcaacctacacttccttacgatcccacccatcatgttgtattataataggctgcttcccatctgtctttcccgctagactgcaagctccttgagtacattctatgtgcctggcccttggtgattaattgctgaaggaatgaaagaacaaaagactacaattacatagccatttctacttgtggaactgctcttgagctttgttttctcttcatcttcaggactaactttaaatatcactctccacccatatgtttaagtctacaggtttctaggcccttggtgagtgaagagcagttcattacgaaatgacctccaagaacaaggctcagcattctctgaaatctcatgaagcagtgtaaccagctctcaagtatcttcctgtgaactagccacagggtatttgatcttatcctttgcttagccagtgcccttcctgctttgtcactgtatgcttaggaaaggtgaaatcattttaacacaaagctgaatacaacagtctccaaagcaatgtatattaaactataacacattatttctctttcacgatatggatagggcagttagaattgactgtatttgtgtataggacagaagatacgaattcacttttactcatatattgtctcattgttagtctgttgggaatcaagtaaattttccactttatatttatttatttatttatttgtatttttagtagagacagggtttcaccatcttggccaggcggtcttgaactcctgacctcatgaaccacccgcctcagcctcccaaactgctgggatcacaggtgtgagccaccgtgcctggccatgtttccagttttaaatggaaatcacttaacatctttgagaaatccagaaggggaagctgttgttcatcctgaacccctcttcctctaaagatgccctcacctctttgcaaccattcttacatgggtatattcccaactggcgagtcagccccagtgtgcttgacttgccttaatccccactctgtccatatctctccaggttctataaagcactggaaaggtgatgccactattgatcgtcacccattgacactcctaatttggggctgctgcttattgtctccaattttgtacctcagtttcccttaccaaggataattcatgttttcatgatccccactgccttggacagaagtgctcaactggcctggcataagttctacagagttcaggccctctctgtcatgattaagagtctgttgaagagatcttctgccttgagtggctctgcaggcctagagttgggaaaggggctagagttgagggttctctgaagtagggatctgtgcacccaaagggaaggttggcagggagaattttagtgggtttctcagtcagagcatgaggtgaccatttctggagagattcagagaccctggatgaggtactatgactctagggacttggtaagtttctgtaaactcggttacttccatgtggtggtggttgtgttgcctcttgacaatttccctgtagtgatcaagaaaagacagagagagagaccccaagagaccctctataacacgaaggacctgtgagcttatgggggtgaggtggcaaagagacgaaatgctgggcaaacttcaagactaacaaatcactgggtgataagctggtggctatacagaatgacagatgtaggaggcaggctgagtctggagatgggagcttgtctgtactgaaaagggtcccaacatacaggttccctgccagatagcaaaacttttctaacagcaaagaaaaacaaaggactaaagctgtcttgaggcaaggaagaaggaagaataaggtatatgttttaccaagtgagaaaagacacaaggggaaaattctgagaggcagcaggtgtgatccagatgtttttcagcaagcaaatgaaagaatttgaaaagtaagctataaaatcctctgagtgcatagaaacagcctgccttactctggctgaggatgaaaagatctgcaaattgcatagatgcctagaaaatcacagaaactgctggctgctaatccaatatgcattttccttcctacttcctaacagcaacatgattctgttcaggaatttactcttcttcatggagtcattttgctttatgggaagctgaccctctcaccaaccccagggaatagtttaatcccataatgacaatccctttcccaaagtgattcttttagaaagggacttccttccagatttgtcaatgagataatagagaagactggtgaaaggcttctgggtttattcctaagaaaggaacatggcaagaaacagtccctttcttcctctaggtattgtcctgtctggaggggatcccaggaactaccagccatttgccacaatcctgatgatgaagttaacatacaatgtggccagaggcaaggaagttgtagactcgctgagctagagccctgctgtgccataccaggagcagctctacctctggacttaattaagtcccattgagttggggctttattttgtctgtagcccaaggaatcccaattggcagagaaggctccagccttctctgggctctctaagattgggtacacttggcctcactcagggcatcttcctggttcaagaattttgcaaacaggttctgaaatctttgtgggtttcagactcccattcatttcccttaaaacttaatttgctttccactgcattttggggataaaaatgggaggaaggaaagtaaaatggggaaaatttcctgagagatccctgaagccaagaggaaaatcgacaaacttacttttccaaaagtgcaggcagtgctgaagtgacaggtaggctgcctttcccattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagaggagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttttaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaaaggcctgggatacagaaaatattttgttatatccaaacgtctttgtctaaaagaaatggaaatgtatttttcctgattattaccaatacattcttattatagaaatataaaaaggcatcaggaagaaaataaaaatgaactattttaccattgcctagagataaccattattagctgtttcacatatcttctaccagaaatttctatgtctacacacagaaacacactcttttaaaaagtacaaaacagaattatactgtttatacactaggttttgtatattctattttacttgcttttgattcataataaattatggataattctacagaaaccccttataggaatatccatttgcttaaccaatctcttattagtgaacatggagttgtttcccacttttcattattatgaacaatgctacaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcacttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacacaggtaagtttcaggctaggcaccagcaggaaacagaaactaggctatcgtatccatgggccagaactggccctcaagggatagcccaagggtctgggtgttggggacactgagtttggcacttcatcctttgagatggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagagcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgtcacgtaggctggagtgcagtggcacgatcttggttcactgcaacctccggctcctgggttcatgtgattctcgtgcctcagcctcccaagtagctgggattacagatgtgtgccaccacacctggttaatttttttatttttagtagaaacagggtttcgccatgttggccaggctggtctccaactcctgagcttaaagtatctacccgcctcggccgcccaaggtgctagaattacaggcatgaaccaccacacctggcctgtttttttcataatctaatctgagattctctattaaccaatagatttatactagttatagttcttgtgattaatatatttgtatttatttctaccatgtaattttatattttctatttattttgttttattcattgactttttctacccctcctcccacctgacacttttgtttggaaattatacattctatttttaacctttagcatgtcctcttaacttttgaacatactgactttaaatttaaaattaaacaagctctctattcttttcttgaataaatcttaaaataataaccctccctcttaattatattgctttccaggatttttatttcaccttgtgtttgtattcttaaattattcattatgtttgttgatttctacagagagtgcttatttagatttacccacgtttacaaatgtctttgttgactattctttcttgtatcctacttgtttcttttgagctcaattttttttaacttttattttaggttcagggtacatgtgcaggtgcattacataaacttgtcatgaagatttgttgtacagattatttcgtcacccaggtattaagcctagtagacagcattgattttttctgctcctctccctcctcctactttccaccctcaagtaggccttggtacctgttgttcccttgtttatggccatatgtactcaatgtctagctcccacttcttagtgagaacatgcagtatttggttttctcttcctgtgttagtttgctaaggataaggacctccagccccacgcatgttcctgcaaaagaggtgatctcattcttttttatggctgcatagtattccatggtgtatatgtaccacatttttctttatccaatatgtcattgatgagcatttaggttgattccatgtctttgctattgtgaaaagtgctgcaatgaacatttgtgagcatgtgtttgagttcaatttcaatcttccttaggtacatcctctagttgttctttcagcgagggtctatgagaggtaaactttctcaattgtctccaaatagtctttaccaagccctcaatcttgcatggtatcttagccatctgtgttatctctagattgacagttattttctcttagttcttttaagaaattattccattggcttcttctattattgccattgagaattgtcattcctttgtaagtaatcttctctttgatgacttttaagatcttccctttgtctttactgttctgcagtttctctttggtgtgtttttatttttcctgcttggaattcacgtattttctgaatccaatgattgatgactttccttagttctagaaaatccttagccattctttcttggcatattttctctccttggttttccccttaaggatggcctaataaatgtatttgggactttctcattctgcattctatatcccatatctcaatgcttctttcataattttaatcaatttatttctctgaactatacattgggtaacttcctcaaacctatcttcaagttaactaatttttcttcaactgtgcccaatttgatttaaatgttataatcaatcaggataagctaggttatactagtttaatagcatagtaataataagcaactccaaagtattagtggctgataacaaggaagatgtgatttgcttatgctacatgctcatttacttccaagtctgcagcaagcttggttctctgtttcctcactctggactcagcctaatactggccttctactattctggagcaatgatggttatcatgttaggaggaagaaacagggcaaactgcattctagttcttagaggcctaggttcagatgtgacatgtccttctactcatatttcattcaccaaagcaaatcccatggccttgccttgtgacttcaaggggatgggtaaatgtgcccagaagaaggagatctggaataatgaagaatagcctcaaatatagtaactaccacatctaaactcttgagtttttgatttctgtgactttattcctcattttgaggagttctattttattcttctttgataactgtattcttttactctgtttttgatccattattttatgtctccaataatttttgtttaagttagagacggtctcactctgtcatccagaatgaagtgcagtggcatgatcacagctcactgaagccttgacttcctgggctcaagcgatcctcccaccttagcctcctgataagctagaactacaggtgcccaccaccacatctgactaattgctttttatttttattttttgtggagatagggtctcactttgttgcccaggctggtctcactttgttgcccaggctggtctcaacctcctggcctcaagcgatcctttcaccttggcctcccaaagtgttaggattacagacgtgagccactgtacccagctacctgtaacaattttaagcttatcttaaaaaaattgtcagatcattttattttccgaggttcttaggatataatcctattgttttgtgtaactgatgacttttgttcatgatgaattgttttcttgtgtattttataattttaagttgtgaagtcatcttcagtgaggctttattagaggaatcctgtgtgtccagatgcagggtctgtctctccagagtacttttctgcttatttctaacatatcttagaagcaccatcttgctgttcttttcaaatcctctgcatattgcatcatcactgctgtcactttgtgagcacgtactttccctatgaggaaggagaaagtgttttttcctactacagtccagggtgaaacaaatttccttgtttctctgctggttggtgattattatttttccttatccaaattccatctgaggatatagtccttggacgcccttaactttctgtgggaatctgtgtcaactctctaccataggtgttccaggccttgtctcagaccacaggcaagtgcaaaagctcagctcccagataaccaaggctgacacttgtccctaaggaagctgcagggtcagcttggtttcagttctcttttcttttcttgtatctgggtatttcaatttattttcttgtggattcagctatttagacaaaggtttgctttattttgtccagcagcaatttctaagtgcttgtggtcaaaagattttcaagttttccagtcagccaaaatagcagaaccagaaaatattctttacatgtgaagagttcatataaattagtaaactaccaagcttacaagtggcaaaggtcataaatacagaatttttaaaagcagaaatacaaatgttccataaacatttggaaaggccaagaaatacaattaaaacaataagacaagacacaattgtggcctatcaaagtcatggatatttacaaaaagaaagaacaagaattgtgtcaatggcacggtgaattgagtattgtaacccattcagtgaaaacataaatgggttatttgaaaataatttgctttaagagccttaaaaaatttatttcccctgagctagtattcatacttctagaaatctacactaaggaaataatctaaaatgcagataattggtaaatttcatattcagaaagaaacatgttatttttaaaaaatgtatatcaccttccttgaaatcagggatattttatttactgcagtcttcaaaaccccaggcatagacaaagattgcagaggttgtataaaggcttaagacacaaacactattagggaacagtcatagagtatcttatggaaacacctgctgagtggttacggccactctgcctagcccaagctgaggtatagcttggaagaacaactggagtggaaacaaatatcagaaaaacacgtacagctatcgttgacctttcctacggtaagcgttttctcatcctcctagagtgaatgtgggactctgtggtgtattctcctcggaagtctgctttcttctgtcatagcactggctacactgccttgacttcccaaaggttgggagctcctttgggtctgtgactgtgtgccctttacctctatattccagtattatatagggcaaaccaaaggtactcaataaatgtctgtagaatgaacgaatgagactcatgggtaactgctcatcctataaatcttaggtaaggtggtttgcaggaggccttgtgcagcaataaatgcaggagtccacgcattaggattcctttggcggcaacttcctcagcttccaacactgacggaaaatggttagaggcctaggtgcatgtgggtcaggagccttgctgacagatccaaagctgacagtctggagcatgtgtgcatgctgcctttggactctgggacatgtcactgatattctccaggaaacttgtgaaacctcctgtttataaaggtttctccatctgttatactttctgtactttcccttctgcagctcttggtaacacggatgtttgcattccacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaccaatgactccccgttgcctagaggctcaaattgctagcatggcctggcgtgtggccctggtcaaccaagtctcacttccacaccctgacactgccactatgacaaactgtttgtttcatcttgttttcacccccaacctccacacctttgtccatgctggtttctccacttgggatgtgtcttcctctattgactggagaactcctatttttactttaaaacaccaacaagataccatccctctttgaaggcttctttgtctcccttcaagcagaatcaggtgggccctcccccgtgctcctatagcaattcgtatagaacttctaaacaagagtatttctttgaaacttctgtcttacccatgagtctgctgtttttctccgtaacatctccttcagccagactctcactccaccctaactgcccaggtttcacccctcacctggactgttgcaagaacatcttcatggggttttctatccctgctttgtcccagtaatgtaactgccacaccacagttaaagggaatcttcttaaactacatatatgatcaagtcattttcttgattaaaatcattggctggatccctaatgctttccagaataaagcccaaattccttagcatgtgctgcctaaaaggggatcccaaagcacacggactgacagggtctagggtcactctcagaccctgtaagtccaagagctcttgtagcccatgggctttgtatccatggtcagccactgtgatttattgctttgggagttaggaagtcactttggaaaggctcatgtttcctggttccagactgccctgccaggcccactgaagcagctgctgggaggcccctgtgggcagcactagacaggagtgctgctcaactggaaataagtcctggggctgttctgacagctctaatcctagccaagagctcttggaagtccaccttgtagggccaagatggggcaggagcctaggtccttaccagaggggccacagctgcggcttgaattctgatttgcaagctttttaaactccatgagctccgcatggtccttctcatacgtcctctttagattctccacatactgcatcatcacttccgttgctttcgacatgcgcttttcctgcggggaaggagcgcatgagtgcatgaggccattggaggaaaggctccgttggcacttatttgctctgacctagggtctgggctaggagaatcaaaaggatacagggacaagactctgccctctgaagagtttgctgtctgccatgtgagctgagaggtggactcagcacctgcgcttagggagaatgagaaaagcacagccaccacactgcaggagatgacaggcagaggagagttgtttctgcttgcagagaacgggtcaggggaggcttcatggagagggaatgcagtggatgtaggatgtgagcagcatctgggcccatagacaagggcaggagggacacagcgttcaggccagggaactccaagaggagtctagaggcagggaagcacagggcttatatgtagatgaggttttatcctctgaataagagtcctctggagagtgaagaaaggcacgacgacaaattatgctgggacaatcgacataataaaccagggctgtccagaaagcccagacactgcaggtcctcctacctatgtagggatcagcaagcagttgggtctatttgtaagtctgggttgtgaaggacctcgaatgctagacaaaggaatttgaacttattctgaaggaaaagggaagccattgaatatctcccttaaagtaagagagtaatataatcaggtcataggtagagatgggactcaagggagtgagactggtggcagtgagggcagcaggtaaaaacaggatgaagcctgacctggcccagtggagccagagaggaaggcaaagactgagacatagcagccaagacgagggagccatttggagaagggagcagatggcgtgagtgacaggtgggctgaggcacaagtttgggaagcctgcacacaatgagaacaatttctctctgctcataccccagttagatccctcagaggatctagctcaggccctgcctggccacagagggacacacccagtggcttcgcaggaacaggtcccacagtcatgcgtggctgagaccagctacttccctagagtcctcccgtgttgctgctcccagctggagtgacttcctgggcaccactgctgagtcagatgtccttgtcctgaaggacacagggtgggatggcccagcgacaggtctttcttttatttaataggaactgctcagggctgcaccaccccaggaacctcctctcatgtaaccagagcagcaggacatagattcatgtcatagcaacataataacaacatccaaatgctttacaagtacggcagcaaccctctatggcagatactgtgaccatcctcattttatacttgaaaagactgaagcagagaaacctcagtaaggggcccaaggtcacacagcgaatgaaggttggagccaggattagaactcgggcaatgtgctcctgctacaacatggggggccggggcggggctctgtatgcttcaggacttcaaagtggccaagagagagccagacctgggcctgtgccccgctccgccactaacgcttttactttctgagactctgcatcttcatctgggagacaggatatttatagggttgctgggtggatttaatgagacaaagcaggttttcctaaagtatgttttgtcaaatactagctccatgggagttgaacaggtattttttgagaaaaataaaatggagagctgtggggggaattcttcagttaaatacgtttgggaactatgtaggtaaagtgaaccagccttctccaccacaggagttaccaaagccttgattaggccaatgtgttagaaatttccaagaaagaaagatagtatgcagtagtccccaaacttgtgcgtccacagaaacctttttccacaaagcaccttgagggttcagtgatctgccaaaaatactctgaataatactgcaatgatgtgcataggatgcctggcccagaggaagccacctctaagtggtatctgtagttgccgctgcttgggtgattgctctactttacgtaggtggaacagagttggcaagaccgggggctggagagactcacctggcggacggcgcctaccacctcagctcggctggagaggcgggcagccaggcggtgcaggacagcgatgtcctccagcaacttctggtaggtttcccggtgctcacagtggtgccagagtgaagctgaggactgaacaggagtaggagcatcacctggggtcctcaaataatgttatggactaaatcagcagtccccaaccttttcggcctcagggactggtttggaagacaatttttccacaaacctggtgggggcgatggtttggggatgaaactcttccacctctgatcattagattcttataaggagggtacaacctagatccttcgcatgcacagtttacaatagggttcgtgaccctatgggaatcgaatgctgctgctgatctgacaggcggcggagctcaggaggtcatgctctcaggcagctcacctcctactgtgcagcctggttcctaacaggccatggtttggtaccggtttgcggcctggcccaggggatgcggaccactgggctaaatgtctgtgccccccacaaagtcatctgctgacttttggggggacatatcctaactcctcaatgtgatagtgaagtggggcctgggcgaggtgattaggtgaggagagtggagccccacgaatggaattagtgctcttataaaagggaccccagagagttctgttctctttccaccatgtaagatataatggaaaggtggtagtctgcaagccagagatggccctcaccagaacccgaccatgctggtgccctgatcttggccttccagcctccagaactatgagaaataaatgtttgccatttaagccacccagtctaaggccctttgttacagcaattcaaactgactaagacacacaccaagcctagactcagctctcatgaaagcagctctgggccccatccaggctgagagaagtggcctctgcagggcctgggccacagtttcttctggtgcttggagaagcccaatgtgaacacgctatccctggcgcctgaaagtaggagtcacacccaggccaccctgcccccttctgagaagctcccaaggctttggaggacctgtccacagccctgagggaaccaggcctttgggatctctgcctcagttccccccaactctctgaggaacactgtcagagtcttggctcaatttttcacttcaggagactatacttggtacctgagagaagcatgacaccctgtatggcccttggggacagtctctgctccagggattcctcacatcaggctccacaattaccgtaatggaagctttgaagttttccagttctttctcagtgttctcctctgtcaggttgcgttccctttcagcctggttaattctagattccagagtgtagctgtcatttctaaaggccaaggacagttgcacaaacacgttctgttgggaacaagggtgtgagagaggtgctgggaggagttactgcagaggacaaggctgcagctgtgctccttgcacgagcgttttgcaacggcccctggaacagccgccaaagcaccaaagcagccatgtgcaagggaaacgctcacttcacaggaaaccacaaaaaagatggtaaagcagggaccaaggtccacgctaggcccttcccagaaccggaggtccaaatgtattctaccaaaaaataagaagagaataacactttgctttttcctgaattttaagaaaataacatcctgtatctgggtttagataaactcaggccagtacagctaattgtgtaagcatctggatttatgctgggatttattgcatgaggggttttggagattttgcaggaaaatactgtattgaaagaaactccatgtgagatttaagcattgttgacgtaaagcaaacttcaatcagcatctagcccgagtattccaaatcctgtattgatagaagctttaagtagctgccaggagattaaataaggccaggtatgattctgttcggttaagctttctggaataaataaatgtttcatgctaaaattgcagcctgcatgaacagactttgaaaagataatattggtcatacatggaattcccagaacagtaggaaactactagggagaagaaatagacagatggacctcactcaggaaggaagcaatggtcttcaattttacagccatcatctgccctgagtggtagcagatttataccctgcagggttagtaaccacaggggcttctgaagttcatgtaacatggcccatggaaggcagtcatctccagaagaattgaaggtacagaattgacccaatgatgatgatgaaggcaatattgaaaactactccttattgagcatctactatatgccagcactgcttttcattctacaaattcatgtaatctcacaataaccctctggggtgggaactgttatacctgtttatgggtaaagaggccaagaccagaacggtcattaacttgttcaaggtgacacggagtaacggagccaggatttaacctcagactgtctgatttgaaagcctgttttatttccaccatgccgagagctgtgtccatatacatctgcggtcagcatttggacattaaacaaaccgcccatggcccatcttcacaaatgtcagtgggtaggcttagagctcatagcccagtgatagaaattttctgccttacccggccttggtcaagtctatgaataatgctcaatgcttaattttctataccttgattatccccttaacagcagtgtgacacaatgagttctgaattcagtgagaacacttggatctaggtcttggttttgccaactacagtatctagaaacttggtgtggttatttactcactcagttttctcctttgtgctgattcctgctccacctgcttttcagagctgctggttaggatcagctgaaaggatggctatgcgtgtgttatagactgcaagtgcaatgcctgtgtgcaagttatagatactacctgtggtagatacttcatactgtctgtcttcctctgcttatctggtccacatcagcagttctcattgtctcacctctgataagttctctttgtccgctacagaatgaaatgcagattcccctcagctcactcacaaccccgctgggacaaggaggccccagtgaggaaaccggaaggctggattgctgacagcacagcttcccggctccgctgagctggcattcttgtagctgaaaccctgaggaggccagccccctttcccactaaactaaagcttagaacttgaaatctgaccatttttcagtaattttgaaataaatttgattcaattctgcagcctcccagctggttttgtgtatctaagtcgtacatttaaagaatataaacaatccttacaggaatgtaaaatttccaactaccttctcccttttgcccaaatttgtcaaaatcttccatgaacggacgtgggaatggggatctcatggttcaagagggctggtcatgaatgttcacattaccccacagtcactctttctcatttttgtctaaaaatgtcagagctagagtctggaggaagaaatgttttgaataagcccagtcaagcacgggcactaaatttcataacacacttgagtcacttacctcaacttccttttcagtgagtggaggggcactgtgaaaaagaaaacacacaattgaactgtgtgcaacctagtcaatagacccaaaggtgactctgaatgaccagcagaccatgtgtttccaggggtggagtaagctgtgttggtgagaaggaaaagatgcaatgtccccttgcctgtgctctgtcacctgtgagatactgactcttacggcaccatgactatctctgtgactttggacaagttatttaatctctctaagccccagcgtgctcatctgcaaaatgggaatcatatcacctaccttgcagaggtattataagcactatatgtactcatgtatgtatgtgtatgtgtttgtatgcataaatatatggcatccacactcagtgggctctcgggaaatgtgaccttgaactcatagccttgctgtgagaaataagaaaatgcatgtgataaggactttataactcatacacatctaagttgccattataattgttctggggatatccacccaggtctgcaaagcctcaccctcctctgtctctgagggctgtgacaaaggtgcatgcgggccagagaataaatggtaggagagagtgaccagggttcttctccacagcaagaacttctgatggctagaatcacagagtggcaagaaagccccagccgacacagaggcatccttttgagcagctcctcgtctgtggcgttcccacagccagggctctccagctataggcagtccctgcatctgcatgtccactcgatgctgctgtggctgctgctcttgctggtaactaaagctggccccatctgaagtccacacaatgtaaataatgcacaggccctttcctgtgctggggcggggaggcctgggaggggtcctaccagcgtcacagaacttggcaacagagcatgccatcaataagcttctcaggaaacacagcttcctctcttgaacgggtgtgaagggaccccaagagcaaaggtaggggtcagccatctctgcagggggctggttctcacccctagggaatgatatgagtgccttcctgtcaggatgagaagaccccatggccatgaagtcagcggagtccagaacacgggacaaacagctgcagggatgtttgacacttacagtccttgtcacaaccccacccatcaggcccttgccttaactgtcatctacagcatacacatatgatttaaatgatttggcaaaacttgccaagtttgtttctgactcctgggtttgttgggatattatgtgaaatgcacatattttcataaattataaaccaaacatttttctatttcaatgactcacattctgcttttttgctgtagaacacacccaccttatttttattttatttatttatttttggggacagggtctcgctctgctgcccaggctggagtgcagtggcaggatcactgcagaggtggcttactacagccttgaactcctgggttcaagcaatcctcctgcctcagccaccagagtagctgggactatgggtgcatgccactatacctggctaattttttatttttattttttgtagaaacagagtttcactctgttgtccaggctggtcttaaactcttggcctcaagtgatcctcttgccttgagcctacaaagtgctaggattacaggtgtatgagccaccacacccagttagaacatacccaccttaaaaaaaaagtgggggtctggggggaaactctgaggactcagagaagtatgatttaggcagagaagccacatggtatgtctggtgtctgatgcagataactgtgccttacaaatgggcataggtacccgggggcagagctgtgagcctctaaaaggacacagcatcttttttaagtgactatttgtatatcttctctgaagaaatgtctatttaaatcctttccccattttgaaaaattggttatttatctttttattgagtgtaagccttctttatatgctctagaaacaagttccttttcagataagtgatttgcaaatatttcattctgtgggttgcctttcactttcttgacactgtttgcagcacagaagtttttattttgaggaagtactatttatttttaaaatcttgtctcttgtgtttttggtgccatatctaaaaaacccaaagacatgaagatttacttatattttttctttgaagagtcttatagtgttctctctgacatttaggtctatgatccattatgagttaatttgtgtgttttgtgtgaggtaggggtccaacttcactcttttgtatgtggctatccagttgtcccagcaccgtttgttaaaattacaatttttttcctctgtaaatcttaccaaaacccttgcatgagtggctttttgtcatttgttatttgcacatctcaaattattactttatcacagaggcctttccttgacctcctacccaatgccccactctcatgtcattctctagatgtgccctattttatggtctttctaccaactttactctttcaaatcattcatttggttacttaaatgttatttgtgctttgggaggccgaggtagaaggatcacttgaggccaggagttcaagattatcttgggcaacatagcaagaccctatctctacaaaaaaatatttgaaaacttaactagtcatgggtaaatggtgtatctgggattgaaacccatgtctcctggctcaaagcccattctctgctgccatgagcttctggtgacccttatgccttcatgaactgtgctcacctaagaaccccacctggcctttgagttgaaaacacccagcctggcctttcattattctttttgtttcgaatgcattatccctatctagacaattggactttggcccttctgggttcaagaattaagactggtgttcctctgtgtcccacctagaatccaacacaggggccactcggtacagggccttctgtaacccacatcctgattttaccttccagggagactcctgtggacccgcagtttgcgcagcagcacatcagaaatattaggcatgacatctaagccactctttgactcttcttcctcaatagctggggagagttcagaaggaagccctgaaaaaaaagtgcttacttataaaatgtctctttgaaatcacagtagtactgttggcagctagcttcaggagctttgacatttataagtatctagttctatgttaagggctttttaattgttatcttacattattctcacaatgagctagaacttagtcatcccatttcacatgtagataagccaaggctcagcaaggttaagtcacttgctcaagattacagaactagcaaatgacatggccagacctcaaggtctacctgcttcaaatgttatgttcttccctttgcttcccacagtattaagctggcaattggaagctggttggctctttggctataatgtttgggaaaaaaacctgctccttggcaggcttctcaggagacctgttgttcaattattcctcctcggataaattaaaatgttctatattatgtatcctacttagaaattaacatctgattccataccccatagataagagattttccagagtaaacctaaggttgctagatcttttacagatctcagaaacataaatgcctcctagtcaacagagacaatgaacagctttttgttttttaaacttctaaaactatcttgggtctgtgctttgaagacagaatgaacaaaccaagtattctcttttccataaatctttctcctgtttgaaaacagctcctgtgcctctctaaagcttctcttctccagactctagctccatttttccaacaagctcactgtgctccactgtggcccatggtctctagataccatcccattcctgcacacattctggtttgttgctgttacagaggcccagatgttctctaacaagatcttagcacaggaagactttggtaaatgtccctggcattgatgtttgttattcatgcagcatagattttgtgtgcctgactacgggcttacagtacacttagcattaagcaaaactctcaacctctttagttgacccaaatcagttatcctcatcctgtataatggttactttccatttgcatgtagaacttcatatttatccatgttttactctttctcctggattttaacctggtagctttccaatctgctcaatcattttccaggatcctaggctaggctagagaccaggactataggcatagttgtagccacctgaagagttaagactgggaatcatgtgaatagaaagaagtctcaccaaaggagaccatgaagagacaagaggctatctagtttggctcaaggtaaaatatgtttaaatactttgagcttgccagtaagagaatggtaggcatggattccttggtactcaaggtagccaagtaagctggaggatcatctgtcagagatgggtcagtcagcaattcttctttggatatgagattcaactagaagttctcttagctacctgttacctctctggttctgtcctggtatttatagctctctgacaaggtttctgtggtaaaccttgtgtcacccctggcatcattctacctttatgtatgtatccctaccacactcaacagagagtcaactgagtagcaagctcctgagatatctataggatgatcgaaacatatgaggtctaataatcaagtgaaatgcatatcagggtttttgcctagaaaagtttcccaaaatggtgcttgaagagtaatgccagaattggtggattctaggaaccaaccaccttcctcctgaattcaaccaaattaacaacaaaaaatttcagaacaaataaaaaatacacaagaaactctaagatacaagaaaaggcaatagtctttaaaaatagtgactagagaaagaataaaaattactaggaataaatgtagagcttccacccatgataaccctttcttcttctccaaagaatcagtactgaaaggaagatgggagagaaaaaattcttacaaagagttcaataccacagaatagagagggaaagggatggagggggcaagtaggcagttgtcagaggagattcagaaagtttccctagaatagaaggttctccattccatcttaccagcatttcgaagagagaaaaaactgcctgggctgcctgccattttgcttttcttactgatgagaagaagagaggaaaggcagaatgatcgcacagaacacagagtggattttcttgaatgatatgaagggatttacaaggaaggaagactaacggtaaagtaaataaaacacgtccctctgaaggagtgaatggcaggagacacatggaaagccccaaccaccatgttctcccccgactcctgaaaaacagtggctaaactccttggatttgccgttttttccttcctttcttagcagaggagtagccgttgggaagcattgggtcaagtctggaaaataaacctacggacagcttgtctctacaattccaacctaaattggtgaaacaatctgaaacccactactaaccacctccaaaggaataagatatgcccccgatttggtataacaaactcacgttttggactatgaacagagttacggaaaaagagaagaaaccaattctacaaacagctctatcttaacttccccttttccccaccacctaagcagtaacaaaacaaacacaaaatatacaatcctcaactaaagcactaaagggaaggctaagagatcccagctaaggtaggaaggagtcaacaaaaactaacctacaatacaatatatctagggaaagggaatcaaggtagaaatatacaaatcagaaaaaaataaaaggaaaacagatggcatggcaactatacaaaaatactatagacaaaagaggaaggaaggtagaaaggaaggaaaagggaaatgtgcaagagacagatgtcaggatggaaacatagttgcaagaaacacatcaaaaaatgcaaaagtatgcttctgtgcaaaatatataccataaatactttgactctagaaaaaataacctgaaaaaaaattaagaaattagagttgggatgagaagatcatgcaaagatggaagatgattgctatttaaggaaacaaattaaagaccaaaataaaaggactaatcaagaaattgggaaatatacaaccaaccaatttattggaaaaatgaaggaataaagcagatatagcttcaagctgaattagaggagggtggtagagattgagtaatcataacgaatgcaaagaaggaaagaaagattgaagtatatggagataaaataatggacctggagttgagactctgatgacccatctatgcattatgttgtctccgaagcagtgaacaaaacaaatggaacaaaggacatattcaaagatataacagaagaaaaatgttcctcacttgaggggaaagttgaacccttcaggttgacagaccgcatcatgttaaaaaatatatttaaatgcttcatacaaaaaaaaaaaaaaaaacccagacatctacatgggaaagtgaagattaagaggtgctggaaatcagctggtcccagctttctccataactttaaatacaggggagcaacatctacgcagttccaaggaaaacagtcaaccaagaattttgtaaccacacaagctgtccttcaagaaaagacaaaattttcaaatgtgatagaactcagggaacacagcacctctgaactctttcaggaaaattgttggaaaacaaaatccagctaaacaagacataaatcgaataaatttgggaaagggaccagtggtgaacatgaaatctttttacatttaagtctaaggctaaataactgtggaaaccatggttacagaatatggaatgtaaatgttataaccttaatgatgtacaaagaagaattcaagatgtgtagaggtagaaatggaaatgtaggaagaaatgtgaaggtgggaagatattcggccattctcatcttttcctgcaggaagtcagtaggtaccattgtagtgactacatgttcttatcttccgtattcttgatgttctgtcacttggtgccttaatcctggagtgacagcccctctcaaggctagctaattcctagaaacaactctccttcaagtgtgtctttgaaatacaaaccagccaatccagaacccacacctgtaaacatcacctttatcaaattctcacgcaccaagccaatactccccctaaatcaccccagggccagtacctgacaactacgggccaccctatagcctaggtcctgccaaaattattcaaactagccaaccctaaacatactgaggatacctaccctgcctctacctttcctttccaagaaaaccccagtaaaggcttggggccatctctcccctcaccacttctgccttctgacccaccctagcccttccccaaggggctctgtatgatgtgccacacatcctgctattagggatctgtgagtataaacctattccttcatgagaatcatttgtgggtctctgtgtcataccatacctgattaaaacaaatgccaggtccaaagtttagattaaatttaaaacctataatgcaaaaaaactacctcataatttatagatttcatgccatccccatcaagctaccaatgactttcttcacagaattggaaaaaatactttaaagttcatgtggaaccgaaaaagagcctgcattgccaagacaatcctaagccaaaagaacaaagctggaggcatcatgctgtctgacttcaaactatactacaaggctacagtaaccaaaacagcatggtactggtaccaaaacagagatatagaccaatggaacagaacaaagccctcagaaataataccacacatctacaaccatctgatctttgacaaacctgacaaaaacaagaaatggggaaaggagtcctatttaataaatggtgctgggaaaactggctagccatatgtagaaagctgaaactggattccttccttacaccttatacaaaaattaattcaagatcaattaaggacttcaatgttagacctaaaacctaaaaaccctagaagaaaacctaggcaataccattcaggacataggcatgggcaaggacttcatgtctaaaacaccaaaagcaatggcaacaaaagccaaaattgacaaatgggatctaattaaagagcttctgcacagcaaaagaaactaccatcagagtgaacaggcaacctacagaacaggagaaaatttttgcaatctactcatctgacaaagggctaatatccagaatctacaaagaactcaaacaaatttacaggaaaaaaacaaccccatcaaaaagtgggcaaaggatatgaacagacacttctcaaaagaagacatttatgcagccaacagacacatggaaaaatgctcattatcactggccatcagagaaatgcaaatcaaaaccacaatgagataccatctcaccccagttagaatggcgatcattaaaaagtcaggaaacaacaggtgctggagaggatatggagaaataggaacacttttacactgttggtgggactatgaactggttcaaccattgtggaagacagtgtggcgattcctcaaggatctagaagtagaaataccatttgacccagccatcccattactggatatatacccaaaggattataaatcatgctgttataaagacacatgcacacgtatgtttattgcagcactattcacaatagcaaagacttggaaccaacccaaatgtccatcaatgatagactggattaagaaaatgtggcacatatacaccatggaatactatgcacccataaaaaaggatgagttcatgtcctttgtagggacatggatgaagctggaaaccatcattctcagcaaactatcgcagggacaaaaaaccaaacaccgcatgttctcactcataggcgggaattgaacaatgagaacacttggacacaggaaggggaacatcacacaccggggcctgtggtggggtccgggggatgggggagggatagcattagcagatatacctaatgtaaatgacgagttaatgggtgcagcacaccaacatggcacatgtatacatatgtaacaaacttgcacgttgtgcacatgtaccttagaacttaaagtataataataaaaaaaagtatattactaagtgaaaaaagcaaggtttggaacaccttgtataatatactacgatttatgtttaaaaaatccacttttggctgggcgcggtggctctcgcctgtaatctcagccctttgggaggccgaggcgggcggatcacgaggtcaggacatcgagaccatcctggctaacgtggtgaaaccctagctctactaaaaatacaaaaaattagcccggcgtggtggcgagcgcctgtagtcccggccgaggaaggagagcggcgtgaatccgggaggtggagcttgcagtgagctgagatggcaccactgcactccagcctgggtgacagtgagactccatctcaaaaaaaaaaaaaaagaaaaatccacttttacatatatgtctatatttagaaatgcttggaatatatctagaagttacactaaaacatagtgacagtggttgcctctgctactgggggacagagatgtaatgagacttactttttcctatgtctcattttgtactttttgaattttgtactatggacatgattatttataaaaattgaattaaaactcataccaaagcaaaaacaaaaaacaaaaaacaaaaaacaaaaaactacctcagtaactccaaaccctttatgcatttcataatacattttttatacttttagaaaccaatttctcttctttggaggaagcagttaccaaaattcagcaagtcttatagtttcacttcaagttcaattaaattctaatagttttaatttcaaacaagtatatctagtataatctccctctttttcccttcctccttctgtattagtggggaaggaggtgtttagtgtaagctatttttactttcttccttgtatttttcactattggttgaatttttagatatgaacataagccactttcaacaaaaagtaataaatttattttcaaatatatctcccaggactagctcattccaatgaaaatatttgtttctgaccatgtcagggacttggaaaaattacttttggagctctgaaagatgctctgagtcccaggatggttcctaaaagtcaaagctgctagttggggataaacttttttttacctctttcttctcagggaggcctctttcctgcccaagacctgaggctctgagtctagactgggggttttggaaggactgtccattcgatgtacttctctgcctcagcctacgtgtccctcaaaatccaggtccagatagccaactaccttctagacgttgccacctggttaaggagaataaaaatcatttcaagagccaccatttactgaacatcaactatgcagtagatacactttgtcatttcttacaatagtactgcaaataaaaaatagcttaaacacctccttccccacaaatacagaaggagcaagggaaaaagagggagattatactagatatacttttttgaaattaaaagtattagagtttaattgaacttgaagtgaagtgaaactgtaggacctgctgaattttggtaattgcttcctccaaagaagagaaattggtttctgaaagtacaaagaatgtattatgaaatgcattttctggagaaactgaagctcagctgagttaaagtgatttactagggtccagcttatcagcagtacagccagaatgcaaaaccaggtttgtctgttgcattcaagctgctttccgtgggcatttgacatgtccaaactcaaattcactgtcttccttctcaagcaaactcctcctcctgtctcacaattcatcaccctcacaaccatgcagacaggtgcctggtggtattcctggtctgcctctcaactccatctcctcatcaagtcctgacaagctgatctccaatagctgtcaaactatcctgtccacatttactaccacctcattacctctcaccaggctatttccctatccttttacctggtgtctccctgtctctagcctctgctgtttcaggccagctctcacaatctgtccagaagaattattctaaaatatagatttgatcctgatgcttccttacctgcaggcttctctttccaaagtgtcctaaatgaaattcaaactcattaattggccttcaaagccttcaatttccttggtctcagcccactgttcccaccttgttgcccatctctctgggacgtgtagctcacacttagttcacatgacattccttctgttcctgaagtatgccaagcactagaagatgcctacatgcttttgcttctgctgtccccctgcttgggatgactttctcttccccagctcaaggtggctcctcctgaaaaccttccctgactcaaccccactgagctagctgcttcttcctctttgttcccaggtactttatggcctgttaaagttttatcacaatttatcgtagtgactttgtctattcttatgtttcctctcctagacagtgagcttattcgttcatacatttgtttaatgtttattgagtgtttactatgtccctggcaatgagctgggagctaaggatacaatgctaagcaaaactgacatgccacatcctctggagctcattattcaggggaacagagattaatcagagaaacatccaaacaatttcacactgagagattttacaaaggagaagggatccgaaggtaccagcaaacccttcccaagaaaagtgacatgagcagatatctaaagattgagttgggagttcattaggcaaagagggagagaggaagaacattccatgcagaagacagaatgtgccatgcgtaagaagaggaaagaatgagctgccgaaggcaggccaaaatattgtgagtgagagtgagtgtggccctagaatatgctggggaagtgggtggggttaactattcagggccttgtaggttctactgaggattcaagtgctcttcctaagagcagaatgaagcctctgaagatgctgaaacagatttgccttctagagatccctgcggctgctgtgttggccatggtgtgagctgggttgggggttgggagtgcagggagaggggaccaggttgcaggctgttgagttagccaaggggactgataatggtagctgggacaaggccttctccctgatggtggggcctgaacccttttcacttaatgcatccccagcacacagcctaagaactggcccacagtcagtctcacatatttggcttgaaataacctgcaactgatcaaagatcaaaacagcatacaatatagttcctgagaagggaactgattgggttgttggaaagactagatgcagcacagaaatgagcctcccagtcctcacaaactgaaggagagccaaaattcttcagactccagaatgttctgataagtatcttttcccatttctcaaaggaacagccaacaaccatcataagagactggatttttccccatgagttcatatgcagggctgtatttagtgcctataaatacaatctgagccagctctcataaaatgctcccaaagccttttatcctgggtatgggaggggacggggctctttgatggggctttcagaatataagaaaagaaagtcacaagtctgcaagtattcattaaacacggagggttgcccaccacatctctagcactgtggagcacagtgtacaagaatatcccatttggttggcaagatagagttctacaacctaaatgacagaaatgaaaatgtatgccaggttcctgctggaataaagaccagtatcacatgcaaacattacagcagcttagtgaagtaggtactgttattaacctcctttaaaagatgaacaaactgaagcgtggagagaattagaaccttgaccaaggctatgcagctggtaagtgatgaagtctgagctcttaagcatccagaccctagaactgagagaaaatgagagggagtgtatattgttggacactgaccatggttaattttatttttaaaatttggtgcttataggagtcacattcatttgcctgataattttacttctaagatccatcttatgccctattaatattggataataaagttttgctgtaggtagtggatgtctaaattggtataattttgtaagctaatctggcagtgtgcacatatacatttaaaagtaaatacttttaaccaatcaattgcaagtctagaatagtagcccatggaaaaaacagatttctataaagatctatgtaagatagtattcattataacagtgtttttaatagagaaaaaaagtggaaatattattacaactggggagaagtagtatttttataatgattgaaataatagaagacttctcaaagggaaagataggcaaacatgattatgtaaaatctttacaattcctctaaaataacacaaaacgtattaaaaagcaaaaaaaagattgaatgaaaatatattaaaatacagccccccccaaaagaaagaaagccaattaagggctaatatctataatgtatcaagtttacatatattaccaacaaaaaccaaacaaatcaacgaaaaaccccagacctaaatgggtacacgggcaaagatgtaagaagttaagtcacccagtaagaaaacaaagtgactattttaacattttaagtttgagcttcctagcaaattaattgaaataataatgaaatttcacactaataataataaacttaaaacaatgacaattattgattattcttactatattctgaataataaggagcagaagcaaacaccagcacgggtaatgcgtaagagaaagatgtccattcagtctttgtcagtagcgttattcattgtaagtaatttgggaaatgcaaatgtttctactctttaaccttgtgattctcaagtctgaacacttatctcaagggaatgatttaaaggaagaaaaaagaacaactaacggtccataattgtttatactagcattgttaatcctagttcaaagaacaatagataggtcaatacaagaggaactatgcacccattaaatcataactgaggagaaattgctgagtataaaataacaagtaaaaaaaagaagctgtatctattcatcaaatcaactgaaaacattataaatatgggcaaatattgcaaagaagaaaaattgttagtttttcagaattgatggggttgtgggtgaaattttaaagtgttttttccagtgttttaaatatgctttagtaaatttaaaattataattagagaagtatatgctgcattttcaaaagatctctttaaagatggttatttaaaatattttgcccttgggaaaaaacactgtttgaaattttacttctgggaaccttcttattaatgctgaataaataggtaggtgtaagttactacagttcagaccaggggcttccaccattgttagtgacatcctggacacattcacccaagaatccatagggctcttatgctgagactggcccccagcagcttgaagcggggcaaggattttcaaatggtgctctgtgaagcctgggtccctggaggtaccttgggcccacagtctcagaagatgaaggatccaagcccttctatccccttcaaccagagcagccccatttgcatctccccaacacgctggcctcctacagatcagcttgtctgaaatgttgtgcagcttaaaaaaagttttaaaactgttcatgagatggccaaaccatgagatttggagtcaggagatcctcgggcctcagtttcctcaactataagagcaagaatccctgcccctcttagctgactgggaagattacataaaatcagaggtaacaaaatggtttatactgtggaaaatgctatgggaagtttattaattaagattgaattaaaaggactaggtgacacggatgaaccttgaagatgttttactaattgaaatgagctcgacacaaaaggacagatactgtatgattccatttctaggagggatctagaagagtcaaatacatagagacagaaagtagaaggtgatcaccaggggctggggagggagggaataaagagttattgttttaatgagtatggcatttcagtttgcaatgatgaaaacgttctagaaatggatagtggtgatggcttcataatatgaatgtacttactgccactgaactgtatacttaaaaatggctaaaatggcaagttgaatgttatatatatttacaataaaaaatagtcccccaccccctctgaaaaagggagtactatatagagtaaaatacaaaagaaagtcaagaaagtagaagattgcagagctggtgggactaacccactgctttaaggaacaggtaccatatgactcagagaggagggagatagcccagcaggagggagatgccgcggggacagaggcacagaggctagagggtgagtggccacagagaagaggctctgggaagagggaagagccaggagcctggcctgttggaaacactcatctctctccactcacccatgcctctttgcccacctcatggcactatggttacagttacaaattattttcatgtacctatctcaatgctcctgccacatctttttaaaaatgtttcttttgagacaggatctcactctgtaccccagagcgagaccctagagtacagtggcacgatcacagttcactgcagccttgacctcccaggctcaagcgatcctcccacctcagcctcccgggtagctgggactacaggtgtgtgtcaccatgcccaggtaatttttgtattttttgtagagatggggcttcgtcatgctgcccagactggtctcaaagtcctcagctcaagcaagccacctccctcccaaagtgctgggattacaggttcacctagccccctgccacatctcatacaatttcattcgttcattcaacaaatacctatgcaggccctagtagtgccaggcattgttgtaagcagtggacacacacacacacacacacacacactcctgcccttgggggcttcttctctagggataatagctgacacctagataacacctgtcatgtaccaggtattgttttaggtactttatagatattagctgctttaatctccataatcacctaagaaggcaggtactgttcttagcctggttttacatgcccagggaggttgaatagcttgcccaggtcacctgagtggtagcagggcttacagttccaactcgtggtggggctcgacatactcatgcaggagaatggggccgaggaagggtgttgggggcactgggagcagggctggacttgcccagctagatctagaggggtcagaaccctactgagaacatcggcagaggtgagtgcagagagggaggcagtgcgggggctgaagcctcattttcagaaccattttccccgccatggttctggcagaaggtggacagggaaccagaggcttggaggaaggggcctgcagctacccagcagggcagggctggggtatggactttgtggtgacagcagattagtaagcaagagatggccgtgatgccttgaaaagaggaactcttcagtttgggcagcttcctgggtgtacgaggaaaaggaagtgtcaaaagttcaggcctgaggcacccttccaggcccactagatgccagcatggcttagggagggctgacagcgaggcctgggggctggttggaaggaggcaggtttggaggtgctgagcgggcagaagacacaatcggattcattcattcaccagcaaatgtttcctgaggaagacacaggaagtcttgtgtttacacattcaccttccttgatctggcacagacaaatcagcactcgctgagacagcatctgccccaaccccacctacctttttcctgctcagctgcttcactaaggtctggaagcttgagccccactaagttctgatttctcatcaggatgtgctcctttgtggtaaaagaaagagataacaatttcagatgatgacactgggctgggctgttctcttggctctgtctatggttctgcgaccactatcttaggtgggaaagcggggcagcctgagaggtgggtgggcaggcatggcatggtgaggcctgagaagcaccaggaaatagttcctctcccagtccgtgaaggtgcctgaaacgccactgtcagcaccactttccatgggtcagggactacccttggcatggtctttttaaacaagtctgtgggcttcagggtaaatgaactgcttggcctcactgtggctgaggtttgcaaaggacacacaggggcagaactaagggctctgggacaggagggtcccctgggtgtgtatggcgctgctcctggaaacagctttggcgatctcatggctggctggatcttcctgccctgtcattccgggcagtgactgctcacttccaggagctgcgattgccccacacactcaggtcatcaatggccttttatggcacctcttgagtttttaaactctccagaaaagtgaggcctgagaattgctggcttagggcctcagctggcagagcccggggagagatgggatgtggcccaagtgggctcacacctgctctaagccaattagcaccagaccaaggacctgagtggaggcacctggcagagctccttgcccctgtgacttatggatcttcagtctgctgtgtggcagagggcacttgggaatggtttgtcccccgagaagggaggaaaggaaggggccagcagagggtgctcatgatccaagtggaagtcatggtcaaggaccctttacccatttggttagcaagccagaggcccacagcccatcagcttcagcacactggagtcgggtaggggctgggcactcaggtgccagggtagtggttagtgacatggggcctccaggttccctgtaacttctctgggtgggcgaaatctgcaggagtgtagggagtgaggaggctctgataaccagaggcccatgaaggcaaatccctggctatcggccccttggctccaacttccgctagagatccgggactgtggcaactcctctgggccctgtgctgtttgatccgctagttagttgggtctttctgactaggaggagttttgtgtgtaaaatgttaacatcagcagccacgccccagctcccctgtgcctccagttcagagcatcatgaaggtatctgaataggatagtggccagcattggaatgtgtccctgccagcacacaaatcccctcaattgtgcttgagtgctatcgggcaccttcttttcttccctgccccacatttccctctgtagaggagccaggagaagcctcctgctctgagggtgctgggcctcactctgtggaatccaggtgccttggtttatattccaagtgggccttctggaggagacaggactggtcagaattgctttgtcctgttatctggtctctatctctggatgcccccaatcataccctgcatagggtggcaaccccacaggagaccgctgtgcctggtttgatggccaacagaagctgaggggacaccatgggcactggaagaaactcaccatgggcggagcagccttcacacttgcagatggacttaaagcttttgttaacaggcatcaggaaggaaggcttgggggcatcacaaaggaaatcactatttcacccttgctagctaatcctaggcatgactgggcactccatcaagggattcctgtttatgagccactgactccggttggaggaggaaagcagcccaggactgaggggcccacatgtccctccacacgtctgccttcccctgagatgtggctttgtgtggcaactagattttagactgagctctgcctggtaactggcataaaaaagcacctaaaactggtatttaggaaagagatgccacataaataggcctgacttctcagagtgggaaaatttacgccctcacaaggcccaagtccaggccagagctgccctggccaggggcccagactcagccctgaggtcttcagcccagggagtacctggagtacacactctgcccaactggcccccaggaacccacctctcggagcttggtcagtttctgcatccgcacgggctgcacttgtatctgaaagtctttgagaccaggggccttggccagcttgccgccggccttgcctgcaaaacgcttttcttcctctgccagtggcagcttggcaagcactttctgcagccgggggccaggttcttcagggccactgtcccaggagagccctcgcagcagcgggggccgggacacagtgggtggaagctcagctttggagccagcctcgggccccatcggctctccagctgggcctctcccctgggaggctgggggacccactcctgccgcatcctgggttggacttctcggcagagggctgccctcccagcccgttttcaagagctgcttccccagctcgctctccacggggccaggctgagggctgttcagggccattttcccactgctgtttgtaacaggagctaggcctttgggtgtggtctcggggtactggaggggatcgaagttttccttttgttctattgcaatctctttggacttctcaactggaggaggacgaggagccagcctgccctgagacactttcctctggtcattctgcttcctgtcagctagccctttggggacgttctgaaaaagacaaggtagagctggaaccctcgggggcaggttgaggggaaacaggtgaggccacttctgctgtggagtctctgcccccacacaccttgccaaggggcccatttgtataagtgtgtatggggtatgagtggacgatgtggaaggagagggcttctgcccgaggtttgtcaaacagacaggaaaatggaacctgcaatccaaaaccagccaagaatttcccaagggataggagctgaggaaaactgaatagaaggcagctttggccctaactcagttgccccagatctagccttggtgctgcttagcaaggcccttaactcttagggacccaggtttgtgaaccctctgaaattatgtatgtgtatgtctgtgtgtggaggggtgtttttctaggaaaaacatccacagctttcaacaatttctcagagttccatgatccaaagaggttagggatcattggatggggtgattcttgcaaaggtgatgtcttcctgctcagaagctctaagattctgcagtgttagtttactttgttcattccccaagggaaacctgggccgtgagcagcacgtgggtctgggggtctgtgtggctgcctcgtgtgtgctgagactcttccagaggactgtatcccagacccagttccaggtgacactaaattctactgctgcccttgaaacactgagcacgtgggcccctcgatgtgagcagggtggggcgcttctgttgctcatcaacaaagatgaggttttcccggcttccccagacagaatcccaggcaggggctggcgctttcctgcccttttcactggagctgacaggagccacagtctcacctggcctggaggtcccccttgtctccaaccagcagcctgactgggggtcagcgctgtgagtattgcctccacggagttcacccccctgaatcctgcctccccacccctccaccttagacttctagtcactataaggcaggggaatctgctgtttccccagccctgaccctccactcatacgtgtgcatgcacacacacttgaaggctgcccaggagccagcctaggcttctaggagactgtgccccccacactcaaatcatccaaagggagcaaagctcaaactcacaggctcgccagggtgaggtgaagagacgtcggcctcatcccccttctgctggagaaggtgaacaggagtcagtcagcaatgggaagagaccgtgtttcctcttgaaatatccccaaggaggccccctagcagtggtgttcatgccctccacccagcaccctcatctccagtgggtcacgaagggcctcctggtgttcggggtaaggggagagacccattggcatagaaacagcacagcaggtggggggtcctgtcacctgtggtggtgctccaggcagaggggatggcgggccactgcacacatccaaacctggaagggtccagacactagtgagtgaggcccagcagcccaggccctcagctgtgctttcagccacatctccctccccgggctatcctccctttgcaatctcaggcctggaagatttgctgactacctcccgtgtgccaggttctcaggtgggccctcacagaatgttcacagagaccacaggaggaaactgaggcacagggaaatcaaagtctcatggccaggaaatgtcagcactgagatttgggcccaggctgcctggccccgacctgagcgtgccctgccgcactgatgagggccggttgcccttcctggcaccctccccctttccttgttggctggagggtgtgactctgggtacagcctaatgaaagggaagaagtcagaccccaaagaggcctttctgtataagctcttgagggcttctctgagcctccctgagccagagaggctgtcctagtcccctttcccacccagccttcctgaccctggggtacacctgcctcccgacacaagcccaagatgctaacagaaagtctatctgcctcctctgggtggcccagcaaatgccccccctggagaggggtcttgctctgggtgtgaaggggccatcagagttcttgaaggggaagcctgcaggctgggaggcatgctgatctgtccaggctgagctgccacccagagcgagaggcagggcaggaagtccccgggcagctgggcctcacctggcggggtggggactgtaagtgagttgctccgagaggatgtaggagaagcgctggggctgaggttcggggaaacagctgtgaagacagacacaaattggctggcattcatgaaggtttaggacttcaacctggcaaaggcatccttttaggtattcccaggccctgggaactgggtctgccttgctgggctcaggggctgatgctggactgcaatatgatgctcctgttacagcccaacccctccctgctgctgctcaagagatgggtgccctcaggccatttgggggttcgaggatagagtcacacttctcagcctgcctggcctgacctcaaggcactgtccagaaactgaggcctggcgttggttggcaggtacagctccagaggctgctccttctcgacttcccagggtggccctgacttcaaaagctccccttgtcctcctaagtacacttacacacttgcccaactttttgctcaggaagaaaagtgactctagcatagaggaagcaggaggatttctgggcccaggaaaaccttccctctaacccagaaattccccaaagaccatctcctcttccccagagggcctaggatccttcccagcacccacagagatcaagggaagggagcccaggacagaatcctgacctctgctgaggagagcaggtgagtccaaggcgacctcctcggaggtgaggcgcccactgcagctggtgccaggcccttccctcccgaccctagaggggctcagggcagccacctgtacatcctgccaccctacctgatggggagtctccggggctgctcctggacttcctcccacggcgggtcaggaatcgctcactcaccaacttggcttcttccagcagcgccaggtttttcttcttgtcctcctctgagatgctgatgtctggcagctggtcattcaccaggtcaatgatgtgccccgcggggtctgcagaaggaggatgagctggggtgagagccactgcatccgtggccccaggctgaggtcatgccataccatgcctcatcccagggactctgcccacagctgacccagccagccaaacctcagcccagtgccatcaagagggttgcatggggacagacagtggcttcctctgcaggcctggcccctatggcttatggcctgtggtcctccgtcacaaatggtcctggagccatctcaggttcccagaattttcctaaactctgtcaggaagggaaggccacccaggagccttacctccggcaccatctgcgcccccagtgcattcttgcttctggcctgtttctttcacaagctaatgcgcttaaggtttgtgaataaaagaaggagaccaaagatcattggccacggccacaaccccgtggccaccttccctccagtcacattgttcaccccatttttctccaaaactgcccctctggatgaggtgggtgaacggcaccacctctcacctggctgctcaggatcacaggagtcactccccacttctccctcttcctccctcccccaacatccaatcagttgatcaagtcctccctgcatttacctataaacatctctggagcctgttcctcatctccattcttgctcattagctcttttttttttttttctttttttgagacagagtctcactctgtggcccaggctggagtgcagtggcacaatctcggctcactgcaacctctgcctcctgggttcaagtgattctcctgcctcagcctcgctcgtacttgttagctctttcctggacaattatgtcttctacctaagaggtccctgccctcaggcgagctcctccatcccatcccccactgcctatcagagtggctatcagagccacatctggccatgccattctccacctcatctcatggggatttctcatgctcctcagtgtggtatccaaaccctaaactgggctcagccagtcttgctggcccccacatactcctcccaagtccctccacttcagctgtgtctgcagtgaacagctcccatttcacctccatcgggttccattcgtctttgggcagcagatccttggttttcacttggtaaaaacctctctgattccccattagctaacccccctcccctgtgccaagagtgggaatgtggactagtcttggccaatcaatgaacagaatccccttggccacagggattggctcggggatggccatgtgaagccattgaggggcaatcctggtgtggagtatatggggaagaagaactctccactgatggggcgtaagcttggagttgctggtagctattggctaccatgtgttgaagagtctgccaagaagaaagctaacacacaagaaaaaaggttcaagagatggaatgggacaattgctaataacccactttgagcacctggatccagcactacctgaaatcacaagccctggcttttgtaaatttttttttggtgtgaggtagtttgagttgggtttctatcatttgaaaaagtcccaattggtacacatggcagagtttcagttgccagcaacatgctccagggaggttcctgctctttcagtgtgtttcctattccccctggaatgcctttcctccctcgcctatctgtccagctctctaaggcacaactcaaatgccacctcctctggaataccttcctaaaacttcctctcctcagagagactcggtccccttcttgccttggctggcctagctcttctgtgcagtctcttatcatacagtgtcccaattatctgttcatttctcagtctcttcatagtctatgagcagcatgaaggcagggaccaactctatatgagatctatgttccaacagcccagggcagatcgtgagccaccatctggggatgagcagatgaccagggcagccggccttacactcaggcacctactccaacctggatgtgggcctctttagcagaggctggaggactctgccccctaaaccccagaaatgagtttcactcagctgttctttctttctttgacttctgcatcttcctcttcatgccctggtcttgtcttttgagcaatgaaaactgaattaaatatgcttctcctagacccagacacggaggggctgatctaccctgtcctgttggacttatcgggagggagcgccttaaagagcaggagagaggaaggagtcaagcccagccacgctgccagacctgtctttctactcaacatgccttagattgccctggtccttacccacagatgtcagggaggcagtggacaccttcaagtgtcggtgagaaagcctcttgtggggactgtgaactctgaaagacagaacagtcatcttgttcagaaaatcaatccacaacttgaaaataggtgaaaagatgcctgtatattctttttctttttctttctttctttctttgtttccttctttccttctttctttctttttttttttttttgactcagttttactctgtcacccaggctggagtgcagtggcgcaatctcagctcactgcagcctctgcctcccaggttcaagcaattctcctgcctcagcctcccaagtatctgagactacaggcatgtgccaccacacccagctaatttttgtatttttagtggagatggggtttcaccatgtcagccaggctggtcttgaactcctgacctcaggtgatctgcccgccttggcctcccaaagtgctgggattacaggtatgagccactgtgcccagccagatgcctgtatattctttcaaagtcatcctagaacatcatcttacaagcttctcgagggtttctctgactctcaacttgggaacgtcttagaaatgcaaattctcaggccccaactcagatcagaaattctggaggtgggcccagccagctatgattttacagctctccaggtgattctgacgcgtgctaaagttttccaaccactgccctaagaggatgtgactttgacttactatttcctactcattaggtcccagactctgagctaacatctaacttgtagaagcctcataaaatgtaaatcattgttgtctgacaaagacgcagatgatttctgtttgggaaaaaagacaaaaatatggtttcattgccctgtagaacattcacctattttatatctaacttagcagttttattccagcactttcctccccactgatgatatatgtatatccattgcttgtatcctcctttgaaccggctttgttatccagatgcttcttgtattaatgaggtaagtaaatctttgacatatgctcagtatatttatatgagaattatctttttccttttctttttctttctttctttttttttttttttttgagacggagtctcgcactgtcgcccaggctggagtgcagtggcgcgatctgggctcactgcaagctccgcctcccgggttcacgccattctcctgcctcagcctcccgagtagctgggactacaggcgcccgccaccacacccggctaatttttctgtatttgtagtagagacgtggtttcactgtgttagccaggatggtctcgatctcctgacctcatgattcacccgccttggcctcccaaagtgctaggattacaggcatgagccactgcgcccggccgagaattatctttttaactttttgaaaattagacagtctcatttcagcgagcccagttcgtgggctagtgctctgtgaaaccaaggcggagacattcctctacctgtgagcccatgtccctgccaagagatcatatttcacacgttttggccaggggcaggattctacattcaaacacctgcacctttcatgtttggctgcaaatagctggacagttattatgggaaactctcctgcggtgatttatgcttttcttaaaggctagccctttccatgggggaacaagtccttctggggcccctgggcattaaatgttttaacctccactagccctgctgggggaggaggctgcaaatgggctggagccgtcgcagagccaaaaggaccacatccaggagaggaaaaatcattttaggaggaagataatggaaaaattcctatttctatcttgtattttgaaaaactgcttgattatagtttagtcaataaaatgatacaagaaaaaagaaaagatttatttaaaaatatagctgtctgatcctcatgttctaggaaatattgtttgtcacaatgcaaggatcaggcacctgtacctgttggccaggtttttgtcggtttctccttctggtgaagtggcatccccagtcaggacaatcgtgggagttggactgcaagatactcctgcggcaggaggaccctgccggtttagaacaaaaacacagagttaggcttgggctggtgggacttccagggacaggagccagagcatttattctcacatcatgatgctcagagccatcttgataaggggacaaatgcagtttactctttattcccccagctttattgaggtatagttgacaaataaacattgtatatattcaaggcacacaatgcgatgttttcattaccttgatacaatgttttgatacaatgtgacatattcacggcatacagtgtgatgttttgatgtgaaatgattaccacagtcaggctaactaatatatccaccaactcacatagttacctttttgtgtggtggacaatacttagcaaattccaagtatacaatacattattaactacagtcaccgtgctgtacgttagatccccagaacgtattcacctcataaccaaaatagtaagttgaattctttgaccaacatctccccatttctcccacccccagtcactggcaaccaccattctactctctgtttctgcaagtttgaccttttaagattctacatataagtgagatcatgcagtattgtctttctgtgcctggcttatttcacttagcatagtgtcctgcaggctcacccacattgttgcaaaaggtgagatttccttctttttttaaggatgaataatattcttgtgtgtgtgtgtgtgtgtgtgtgtgtgtgtgtatacagacacaatattttattgtgtatatatttttcacattttttaattcatccattgacagacatttagattgtttccataccttgtctattgtgaatagtgcacacatataggttatttggattactcagaaaacaaaaaaggcagtttctcctttattccccagcaggccctcacctgagcttaacacggtccactattcatgcactaagattagggacactacaagctatccctggttagttctcactagcaatgcaggaaaagaatggtacagagtcctcagattgaggccagcctggctggggaagaatgatggcctggggaaaaggtagtggcacccacacacccctgaggttccacgacagtcctacctttgggtaactttgacatttcagtgatcgtaatttgttagaagactctcctggggttttctcttaggtccttccatcaacttaagagggtgcctgtcattttccttctcctccttcccacccccttgactggcatgtgctgccactgctccctctgtgagcacctgactgcctttgccaaaggcctgcctcctagcgtcccagagcatgttgctgccacctccactattggtgctgcctcccgcagcttcaaagcagtgggtgcccactgtctctattgccactttccctggtgggccaaatccttctagagcccctgcatatgaaatgttttcacctccactagccccactggcggtgggagctgccaatgggctggagcctctggcagagccaggctgtgttcttgagccttcagtgtgcaggtgttggttccctgcaaggtagggaggaggcctgctctccttttgacattatgccttgttgtgaaatgggtctcatacagtgctatctggacttcttacgtcccacaatttttagtgaacccagcttttcccattttcattttcatctcttcccttctttggccccaagcataaggccacatgagctggagaagtctctgggtgagagtccagctggggagcaccatgctgcttctcttgtggaaaggatgcttttatgtggaaacccagagccagatccttgaggagatgttcattgggctctgtgttcttatccgggagcgattcagtgcagaaagctacagtggctgaaggaagaggaggcactcagaatctcccgggacatggaagggaagcttgggcagggacgtgggctgtgtagaagcagaaggaagcagcattgcctattggaagggtcagacaaacctgggctcaaatttcaactactagctatgtgtcgtggacaagttatttaacctctctatgatccatgattataaagtctaactcacaaggttagtgtgaagattaaaaataacattgataaggtacctatgcatgattgacatttttatttatttaatttatttagtttcttcagtgcagtggcacaatcatagctcgttgtagcctctgcctcctgggctcaagtgattgccctggttcagcctcctgagtagttgggactacaggtgtgcaccaccacgcctggctgacttaaaaattttttttttagagacagggtcttactatgttggccaggctggtcttgaacttccagaatcaagcgatcttcccacgtctgcctctgaaggtgctgggattaaaggtgtgagccacgatgccaggccatgattgatattctaaatgtgctaagcatctagcatatgattaatgttttaaataaatgtgtacattactttagatttctttctctttcaacaaacactttatggttatccaccatgtgccaaaagcaacttgagatatgaagagaagaccctaaagggctcgcagtcaagcaagggatacagggaagtaactcataataaatataaggaaacaagggatggaccacattctgtgaaagctcagaggaaggaaaagaaaactctttagtgaggggagttaaagaagactctatagaggagtggacatttgagctaggtcttgaaggatgaataggagcttgcacgacaaagatgttagaggacaggatttggccaaagggaatcgcattagcaaaaggcattactgggaatcagggatttgtcagtgtagctggtgcaggtgcatggactatgacatgtgagataggagaggtcagggctgggggaattgtgaaagtacaataagagattgagccagcttctgaaggacctcgaagctactctaatgagtttggtctttatggttttggagatgggaagccctgaaggttaggcttgagaataacttaactacccaaagggaaatacagaaatgttgacagcagatcatccatgcatccctctattcacactggttgagatgacagaagaggcccagttattagaacatctatcatcccctataggaattctgaggagctccctggtaaataggagctgtgtctccatttggaaacctagagctggccaagagggagtgacaagaagtcagcacgtgcttgtggctgaaaccaagactggctgacctgtcctcatgatcccagagctccagtccctctgaggacacagatacccatccttctgtcaaggactccccctagaagagacacccagggagttttctgaaaagcaacaactcattctctggatagtatgccttgatgggctggtgataagcttgtcctcctgtggctttatccctccgttcctataatggcacaatggccaaaggcctgctctctctcacaggaagattatgcaagtaaaaagaaatgacgaatgtgtatgcactttgataagtgtcatatggtctacaagtacccttgagtcatgattattattaaaatgaatgatggctctattcaaggtgagccagtttttcccatcttttgttcagtgggctcccctggtgggaggccagcaagcagcagaggctggggtttccaggggaccagaagagaagtggaacaatgatctggggccccgaggacatgcagtggaacagtattcacaagggctggggaggttaagaaggggaagcagtgtgtcaaatggcaggtagccagatagagggggcagcaggcagggccaggggcaggtgccaagctaaatgggagagccagggaagaagaaggaatagggagttttctactgtgtgggttttctggtgagtaggaagagctgaagtctttccagaggaatctcttcacatcattaaaaaggagtagcattagcaaaaggcattactgggaatcagggatttgtcagtgtttctggcaggtgtgatctcttggatgtcaattaagcaatcagcatcctctgatgcatattctgagctcagaggtgcaaattagagacccatgtgcctgtttgctagtagtgtttacaagtttttaaattagttatcaacattccataattgtaagaattcacataaaggtctggatagcctgcttttccttaaactgaaagatcaaacaatcttaggcccatatttctgcagagtaaccaggtttgagctatcctaaattggctttcttcagtgatttgtgctccctggccccaaatgcatctgagttactgccctgtgtcatgtagttttcatcctggcctggttttccagagcacaggaggtttgtgcttaaaatctctcccacccacatcatctgggcagcctcatgcctatcaccatgggaacgccaatggaaactctgactgtgcttatagcatgcgcgggcttctttccctggattttattctgactgtgaaaatttgagctctgaaagttgcctttttcatgtctgtcatatttagagaatttctttcttgtatgagtcctctgatgaacaagaagaaatgcattttgtctaaaatatcattttttacatgcattctatcatatggtttccaccaccccttgtggtggggctttacaaattcctggcatgcattgatgaggataagctgtgtctatttaaaggggcaggatgggccaaacatgagctaattccatgttgtattctgaaaaaataattgtggtggtattaggagagttatagcatatatccatttctaacagtttcatatattcaggctgctaaataagtaaaatacatattttattttatttttatgtattgttttgagatggaggctcactctgtctcccaggctggagtgcagtgatatgatcttggctcactgcaacctccgcctcccggtcaagcaattctcatgcctcagcctcccgagtagctgggactacaggcatgcaccaccatgcccagctaatttttgtatttttagtagagatggggtttcaccacattggtcaggctggtctccaactcctggcctaaagtaatctgcctgccttggcctcccaaagtgctgggattacaggcgtgagccaccatgcctggcctttgtttatttttaatcttattgacactatctacttctcaaagcaacttgaagtaaccaacaataaaatataagatataaaaacatgagactatataaatgggggaatgatggatgatttgacaaacataaatatccctagcagacaaggagaacctcatgctcctaacagtctatggttgggagttgtggttaaactatttgccctgaaacctaatgaagccgtgatccacgtggcgcagactctgagaaggctcgccttacggaactgttcaacagaaagaaaaccagcatagaaggaacttcattctttactctcacctctcaaagaacatgaaaggggaacaaatcttcactcccatcctgacctctcctctgcccttttctctttccttaacgattctcacgccccctctctgatgactcttcccctgcttgcctccctgcccagatcctctgtctaccttctttctctttttctcctgctccagcctttactcccccagctccatccagttattttttgtgcagattgtcttcatttgtttgtatgattgactcacaaacatttactgaagagtcttacagagcaaagaccttcttggagaagagaggggcactgggctggcaatgatcagattctgtttggcgtccaagaaagggatgtggtctgtgaacactcccacattattggaccttattctgtccaatcatccggcaaacatttattgaatgcctattgtggccagggtctatgctaaggtctgggaagacaaaggtgaactgagcgggcctctgcaatgcttcccattcattagcatgaaggaatggggagagaaggggaagtaacctccactgctattactaatagtgccctcggtgttgatacctaccaggtaaatgggtacaaggcacgggagtgagctgccttctgataggagctttctctgcttgctggctaatggttacctgaagcaaagctctcctgactgtaggcatctcactggggaggaggaccatggcagaggtgcccatacaaaaaggcagaaacaagccatgggtggcaagtgccaagcaggtaaccgcagacactcacaattccaagtggcttacaaagcaggaagcataaagcgattaggaggaaatcctctaatcccttgatggaacatcctggaaggttcttcacacttgccttctaatgtgtgcaaaatacacaactcataaaatcatagtgttctttccctcatcagctgacagaatcgttgagcaagctctgggcaacttctccttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggcaggccttcaagaaagcttgggagagcagtaagaccaaatagcgttggccagacaacctactggcttaggggcttcagggcctcaggctcagaagccacactaccttatggtatactttttagctggataaccttgggcaagttaccttgcctctctgtgcctcagttacctaatctataatggaactatctcacagggtagttataagaattaaacaagttgatatagaaataggatttctggataaagcacaggatgccccagttatatttgaatttcaaatgtacaacagataatttttagtatgtgtgtctcaaatattccatggacataactgtattctctctctctctctcgactgaatcttgctatgtgcccaggctggtctcaaatttctgggctcaggtgatcctctcacctgagtagctgggactgcaggtgtgagccaccatgtacagcatataatcatattttcattttccaaatctggcagccctagatggcaagcctgtggaagtgcacctagcactgagcaaatgctcactaagcattagatgttatgttcccttattattcccttcgggattgaattaatgactttggcatttggttttgaaaagatggttgctcttagttctgggtctcctcaaccatctggagttaaattgggagagcccagccactgtggtcacggcgcaatggagcatctctcctggggcatctgaccacataagcccaagtgatcaaggacccaccaccaaggccaccttcacccggctccactccctctcaccctctgcctctcaaaccaatcaatgccctttgtgggttacagacatggaagcacagaaacaaacatggctagagggaattggcagttactcaggcccactgtgtggtgggccctgtcccagacccccctcgtgttttctcaccgaatcctcccagaaactcagtgggtaaacctgaggacaccacctacaaattgggggtgataatgcctcccaaactcatagaattgtgaagaggaaacgagaagatgaaagtgaaggccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctcccctggttcctggtgccctgctggcctctgacactcttattcttccaagctgcactctccttcacagaaggtacctcttcctccaggaagccctcaaaccagcacaaggctgaacacacagctggagaaaaggacagcatgggcagaggatgcccttggctcactgcccttctcactcctccatgggcccagcctccctgggggtccatttcccttccctggaatcagccaagcactgagggctgggtcatctcccagcaagctcaccctctaataagccagcaggccacattttgttctccttaaataaatcttatagaaacatttaaatgtttatttcactcatagattctcaggaatgcacaatagttttcctaaccgcctgggcacagggataaatataggccagtgtcatagatgggaatattagcttcctttccccagagtcacatggctaggcccaggctaggaaactgtaaggaacacccccagccccagctccagcccactccagctcaggcaggcatggggggtttagatcctgtagatgggcgctggcagacagcccaggagaggaggaccctgctggaaggcaatgtgggctagtgaagaagtcgggtaggcctagaccagaatcccacctgggtgaccttgggcaagttactagttactaaacttctctttcatggtctaaaacattacatagagctaataatcactattctctaggcttgttttaagtattaaatgagagaaagcaataataatgacggtgaaagtggtggtggtgggtgcgtgctgtgagactgtatccccagatccctgtcttgtagcctggagggcaaacagggactgccttggtagagaggagatccagcagcaaaagcagccagtgctcttacaacaggataaaaggactctctgggccgggcacggtggctcacgcctgtaatcccagcactttgggaggccgaggcatggcctcggtggatcacaaggtcaggagatcgagaccatcttggctaacacagtgaaaccccgtctctactaaaaatacaaaagcaaaattagccgggcatggtggcgggcacctgtagtcccagctactcgggaagctgaggcgggagaatggcgtgaacccaggaggcggagcttacagtgagcctgatcgtgccactgcactcctccagcctgggcgacagagtgagactccgtctcaaaaaaaaaaaaaaaaaaaaaaaggactctctggggacttgaaagaaaatgattatcccagcggcaagtcctaggggcacaggagagagcagaagtgcctctgctgagttctgctggacatggggctcctccctgccaagcatagagggccagttccctggctccccaaaggctccccggtgtcttccctataggccctcccttgcaccaagggcctgctctgcctctggtggatcctctttcctgccattgtccatttatttctagaagtcagatataaagaacaactgccttgttcatcactgtttttactctcatgccaacagactctgggagtgtggaaaagcacacaatatatgttagctttattccaaggagagtaactcagctagtcgttcatccgtcatatctactatcctcccttccttcctcccttcctaacactactccaccctccatttcttctgccttttaatgcagtcatttagtcatctagccagccaattatctacccaacctatcacaacacaatcaagcatccatccacctttccatccatccatccctccctccctccctaagctccgaccgcatgctggagcctatgcttatgggtggagatacacatgtgaaaggcacagtctgtggcccgcaagtagctcacacatagcctgatgtgtggagacagaaaaacaaagaacagcaatctgtttcattgctcacaataggaactaagggaaaacaatttttatatgcatttccgactgtctgtaaccgtcaacatttctaaaacactttctgccttgttttaggcacttccacgctaaattctcacagctcttaccctgtgaccagaaccactagaggccagcctggtggaactgtcctcttgagctcttttttataatgatggagcatcaagcacctgtttcccatgcatggggcctctggtgtcctagctagggccaggaaaggaaggaaaacctggcaggatgacatcagtgggaaacttgagtttgaatctctatttgaccacagcacagctaggtgatctttgacaattacataaactctcagagactccatttcttcatctaaaaaatagagataataatatctaccttggagggattagaccacataccaggtgcccagtagttgctaccattatcttgtataccagatactaatattttattgataatttattttaaattattttattgaaggccttaattgaggctgttcttgcaaaggatgtgatgagataagtagaaatgaactcagagaagatgaattcaaaatcctcgatgggagcatccaagtacttcctggtttctggtgagtatagtgcccttacctgcctgttttctcatctataaagtgggatagccatcatgcctgtgtcttggagttgtcgtgaggttgctatgtgtaaagtgcctagagcagtgcctggcacatgggaggtaccgtatgagggttctcactggggaagctggggggcagggggatccctactctacacagtccttaccaggttccaagtgttttacatgctttatctggttcctcttcatctcattcctgacagataattgatcctttgggtcacacaccttttctctagtcgggcagcacacggttcccaaggagtttccagggaggtacaggcagaacctctctgttggccagtgaggacagggcttgaacagccaaaaggagtcaaatggatagagaagctggcaatctgccttcagcagtaaagtatatggctaaactcgagatattcccatagacagcgcagaacaagtctcctccaggtcctgatgggagaaggccgtgggagaacacaagagcaaattggatctgacagaactggcatttggtagtaaatctaccaggaagtgagcttcctgagagcaggaccttagttagttaatgctcaataaacatttattgagcaaattcaataaacattgactgagtaaatgtacttcaattcctcgattccatatttattgagtgcctaccatgtgtatgtgaataatcatcccttgcctctgtgctcaaactctattgcatataatggggtatttttggaatagaaataggaaaacaattaattatagcccatttcctcagcttacaaccatgagacagtggaatccgggccttgctatttccctattatgtgattttcagcaactggcttaacctttccaagcctcagtatcctgatctgtgaaatgtgcatagtcatcactaccatgtacgactgcgttctgaaggttaaatgctagaaaacactaggaacctgtgtgttagtttctttcccttcatctggataagatacctaactgctctaaattcgcactttcatgggggtgactctctctgctctgtctacctcacagtggttttgcacttgcaatgtcattgcacttgcagtgacacatgtggaaactttttgcaaaccgttttgtgctatagggactgagcgcctattgtgagctaagtactttgctcatcactttatatatattattccagtaattaaagtcaagctgcctgggtttgaatttagcctcaaccacttccttagctatgtcacccactgcacattacttttctgtgcttaaattctttatctgttactggaaatactaatagttttcccaggagtattgcgagaattaaatgagataatgtaacatataaaacaagcctaatatggtacctggcacatagtaagttctccataaaggttagctgttgttagtggctattcctataactcttagtttctagatgaggaaactggggcaaggaataatgaggaatcacttatccaaggtagcagtcaaggatgtgaagcccaagttcttcctgctctgccatgctgcttataccttacatttctatgagcctttcctgtaccttctggaactccctggctgcttggtcatcctcctcttcttaaaggacagacaggttggctctgagcccagcccactgactgagggtgtaagccaggataggcctcctacaacccttgtccactgtttttactctcatgccaacagactttgggagtgtggaaaaacacagtatgtgttagctttattccaaggagagtaactcagctagtcattcatccatcatatctactatcctcccttccttcctcccttcctaacattagccctccctccatttcttctgccctttagtgcagtcatttaatcatctagccagccaattatctacccaaccccagatttgttatggtggcacttacatcagtccctatttctgagccaaaacaggaggaaggccagcacctccatagccagaggttctaggtgctccacaagcagatcccttcctataagggccacacaaacaagactgcttctccagagcacactccaaccacatctcagttacttaaaagttacgggaggggaggggtgcagatgccactcatcagtggagtgctgcagtgaccttaagtcacaagagctactgcgtaacagggctgagcatccatgtctgcctagagcatcaacgaatgaaacacaaagtggatgctcggagagacccagagtgcctcatgcatgtggcctaaaccaggcaatagcatggtggcctgtgtttctaggagttaatgtgcccttccccttcctcaatgtgtccatgtcccttcctcattctccttcagctaagcaatcagacagcccactcaagttaaagttgggctgtttgattacctgactgaaggagaatgaggaaggggcatagacaggcatgtgacatgcagctttggttgctggccccacgagcttgtgctcctgaggggctggcaggcagaaggggtttggtggtgctttggcattcccctgacagcgagctctgaagttggcccttctgaggtgagtggctttgggaacacaggacaacgtactgttggcccaggtcccagagctctcactgaggacccaggggcagtaacagtgctcagtgcgggtatggactaagcatgggctttggggtcaggctgcctgggcccagatcctgggcctgccacttatgagctgtatgaccttggaggaaggtagttaatttctttgtgcctcagtttcctcagctatgaaatgggaatgataatacctaccgtaaggctaattatatgttaaatgagttaatatggtagacgagtatctggcacagggttagctattattattaagtggctttgtgtgcagcggaggtaggggaacaggggaggtggtagctgggtgctggaatgggtgatatgaagaggtgaagtctgcttatgagttcacactgacctgcccctgggggcttctaaaaccctttggaggaggatgggagttgttcaggtggaagctagagccggtgaaaattgggctcttacagctaacatgagcctctttgtaccctcaggtttacaaggcacttcagaggatgctgcactgtctgggtgagtcagcttcctactgtggctgctggtcacagtccaggaactcatctaggcctaggtaagattgcatctggagcctggggccaggtctggggccctacagtaaggcggagatgggctggtatgtgtcctgagcggaggttaggaaggctctgaacactgtcatgggagcaaagactgaagaaactagagaaaaagagactctgagaagactcagaactgcctttctgcatctgtaggatttcaccccactataggttgtatggagggcagaaccgagggagagtcttgggggaggcagattccagcctgaccaggacagagctggccaaccagtgcacaggcttccttgggaggcggtgagcttttcattatagaaatattcctacagattcctaccctgggcccggtggctcacgcctgtaatcccagcactttgggaggccgaggtgggcagatcacttgaggccaggagtttgagaccagcctggccaacacggcgaaaccccatatctactaaaaatacaaaaattagccaggcgtggtggtgcaggcctgtagtcccggctattcgggaggctgaggcacaagaatcatttgaacctgggagacagaggttgcagtgagctgagatcacaccaatgcactccagcctgggtgacaaagcaagactctgtctcaaaaatacaaagatatattcctacagattcctaagacctacctcaagagattccaattcagtaggtcttggatggctgaggaatctggtgttcaaaaaattcccagggtgactgagtggggctcacgttatagagagctttgcctgcctgggcggagcttagatgtgacctgggattcttctagcactggcagtctgtcattctgtggtcccctcaggtcccaggcttgtgttctgacagcttctattcctgctagaaccccttggctacaaactcttccctttgagtctctccctgttcaagggccaatgcagaaaaccccactcaggacatagccttacaaagtgcattgttggggggctttttgtggtatttgattgcagcttctgattaaggacctgaagagtacgtctgtctgtgcatgcctgtgtatctgcgtgtgtgtctgtgtgtgtgtatgcgtgtgtacgtgcagaaagagaaacaggatctagtcctacagattttgtgtttgtgtgtgagaaggcctcggctagtgctcatgccagtgatgggaaataggggctgggacctgaggaatcacaactagggctggaccccggggagctgtaaacttagaaggatgctctgttctttgcctgcttcacagactgggaattcaggcaggattgggacttccagccgagtcatcctggccaaccccgcttccttggctgcctggcctcggatgctcccagggactcaggttccagccccctgaaggctccaggccagctcctgaggcctgaccctcccgaggccgtgactacctgagaaacccaatgtgggtggtctggtgggtgcaatagtgggagaagcactttactcaccatgcctggttgccttctgaaaagctttgaaatgtccagggcgtggcagtaagggaagagggtaaaagaaagttgagtttgatgtggcctttggttgggggggtctgaactgccccagcttcatggtccctcaggctatagaaggcacttgagggctgggctgaacaggcagagtctaggaggcagcaactaacccttgtactgggtaacacataagaaaccagcagcacagcaaagttaacagacttggtctcaaagtttcttggccaagacaaggtctcttgaccagaatgtagaggagctgggattgaagcccagcttggtatgactgcacagtttacattcttaaatcctgtgctaggtatcctccctgataggacctgggcttctcggctcccggctcccctgaattcctgctggccttcctaaccatcacagcttcaaaatgcatataggtacagtgccattaggttggcatgatgaatttctagaggttgccacaatggggggagggttccatgagcttgcctgccacaaagttgagagtaagcgatccctgattggctagtgggagctccaaattccagttccccacaagttcagtctccctgtgaccctgagccagaaccagactcttattaaataacggatggtctctgaaggcccttcaagtgccatgattctctctgtgcccatgggaaatcaagactatagagagaatgtttgcaggtactgatagcttctgcattattggggcccagcagaaggacccatgagggaagaatgcatgagtgaacattatttttacaaatgggtagattcttagtgaatattctcatgttatgattacatttgttttcttacacattacaactctgggaacttaagtaacaaacactttaaaaagaatggccctttggatctccatatcccaaacccatgggatcaagatgttgtagaacttggcagtcttgtgggtggggagatgcccttcccttgaatgtctaagtgacaggtgtctatgttgtcttgttttatgtttcctgaggatatactctgaaagaacttttaattataaagcattgtaagcaggaagaatttaatataaaagcctgtcttcactgacagcaggggtgcatctttgctgatcttttattatcttatattttaggaatgcttttagtcttggggcagctgtttgggggagttgcccaggatttaagagctacattttgcctgagaatctgattcaagggtactaccattgttagtaaagtagaaggggccagggatggccattttcagaggagtccagggcgaggaaatagggatgctaaggagacagaggccaagaaagtcatggcctgagggtctggaagcagtcgcatttgaatgcagttgtgagtgttttgtctctcctttccttaatccccaagcttttggaacttggcaccctcagcagcaggacccactatttcccagaatgggggcctggacttgataaaaccctgggctgggctgcctgaggctgaagggctagggggttggcccactgtcacttagacattcaagggaaggacaaccccctcacccctaaggctgccaagttctgcaacatcttaatccgatgagcttgggatatgcagatacaaagggccattcttttctaagtgtttactatctaagttcccagagtcgtaatgtgtcagaaaacaaatgccatcataacatgaaaatactcactaagaatctgcccttttgtaaaaataatgctccacttatagattcttccctcacttaaaaagcgtctatcccacctggctcaggtcagtttggatgactgtccgatataacaggacaataccatttcaatgcaaatcaactgcaaagttcatgaagtcaaagaaaacagtgatggagaattttacatgcaaggtctttgaccaaggagatcagatagagcttatcaattaagtgaagaaaatacgacgaggatgatgctcaaataggttcttcaaaagggaataatttgaatatcgagggactgaaagagatccttggggaaatggatgaagcccttaagtattaaacagacgtagactcttaattaggtgctgtaaagtaaaatgtgaagagcgagttactatgtgaacagatcactttgctggtataataaataaatatacccacaccaaaatcaacattttattctttcttcaatctgaaaattagcacataacctatattttgtaatctgtatagctaaaaatagcttgttttgaatgcctcatttgtacaataaaaatcttgatgtctctttaaattaatctgctttcatcatttcctttctataataaaatttcactgaaaaccttttttgctatttactatacaattttgatctccattttaagtggattcactttaagtggccttttctcgtgcccactcacctgacataagaggttctcagtgctaatggttctcatataagtccttctccggtttcagagggagcctgcatggtttgtggtttgacttctgaggcctcagtcagacacagcctagatggttggttctatacccagaatatttggggcctcggtcaattcaaaccaactcagagtaattgattcctcagtatggaagccacacaccttctccaggtacccactgcaacctacatgagctgtcagcaaaccctctggccagcctaaaagctgtggcctcagcccagggtgcttggcttggcccccagccaggctagctgagggcagggagggggcacttacttggccggcagggctctgggctgcctgtggctctccggggggctcctcgtcctcgggaatgtggggcatggcagcctcctgctgggagtggccacgtgtgcccggaacctccgctgcgtcagccccaaagatgctccaagaggcctgggctccacaggctggggagatgccaaaaggacaagtcaaatccattcccatccctgtcccaagctgggttccatttcccggagccacaagccacagtgagagccggcttgagtttgcatcaacaccggaggtcaaaccaggctaggagagggcatttggaatttcatttcctccggctctctggctttgtttacaaagtcagaggtgaccttagagattttgcatctaatttggtctttacagtaaacacagctatcccagaagggagaaatgtgcttcgaactcctcaaagctgtagctaatggaagatactccattgagatcacattggcagttgtttaccacttactgagcacctactgggtgccaggccctgtcctaggagcatcaccatcatctgattgaatcctcaagatgacctctgatgtaggcattaatattcccattttacagatgagagaaccgccccagagagtgaaagtcacttgccccaaatcatacagagaaccaataatttgaacccagatcttcctgattttgaggctggggctttttctgctatactacacagtgttcctcagccatgtggatggggagtaagaggtgctgtttcctgacttcctccctgacacctcccctcatgctcttctgaccctcagcacaggctctctcatttgagttcagcccttatggggactacaccagccctactaaaacctgggggctcaggcagggtgaattccatgtgccctgtgcccacccctggcaaccttagattgactcccagaagccaggctatcccttccccatggtgcagcagcctgggggcactggggtcccagtgctgattgggactgcaatcagcataatctcatccacctcccacagtgactggctcagggatagacaatggacccagcctacatcgatgagcttaaagtggtgttctaggaccagatgctttctcctgctctgagtggtggagtgtgaagatatgagacctggtgctacggacactattttgcttccatgaggaaagccagacagaatctaaatgatacacacagaggagggcagagcgaagggacctgcagagaaacagaactggagccctgattaaagtgtgcctgaagcctgaacactttctggactagctggttacatgaacaattaagcctcttggtgttgaaatcactttgtgttgggtttttgttccttgtaactgaaaacatgctccactactctttcgtgcttcttgtctgtcaagatgcctaggagtatgatcctgccaacagacctgagccaatgggtctagctcctctgcttcctcttagaagaggagactagcaatgccaggtttccatagggaaaggcaggatagcaatgtagaaagaacacaggctttggaaccagatatctcggtgtgagtcctcactttgccactcactggctatgtggccttggaaagtaggcttcatctctgagtcccagttttcttgtcaaaacagataagaatgcctcccaagcaggatgctccaaggatgaaacacactcagttcacagtagttcccacagaggccacctgcacgggggtctgcagcccaggaagcttggccgaagctccaagggctctgcctggcctctccccatccttaaactccctccttcttttattagtggggtgggcaataccttcaggaatctatagaactaacaactggcctggttctgcaacttttagagattccctgaaggagctgctccactgcacagtagattaagaccaccatgcagataacatagtgaggtgacctttggctgatgggacatggtgggtgggggtggagatgaaggacactgtcatttactgagcaccaactgtgttccaggtcctctggaaggtactgctgactgctggaggctgtaggaggaagaaccggaaagccctgccacctcccataatacttggtgttcttcctgtccttcagaaagggctcggaaagcccctagagtcagggcactggagaaaaggcctgagctgccatcagcccagctctgacagaccccccagccaacacacatacctctagactcctggactgagctccttgagctaggcaaggtgtcagattcatcctaggtacccaaaagattcagcaaagaatgattgttgatttatgtttaaagaactagggacttttagccccaggattggtcaaggtgaccaccatcttgattgctgtctttctctgcaatgaacaagttagcccacacagctctggaacagttagggtgacccctactggtcacctcaagaaatctcaagtagaccatccatagagtcattcattctttcactgccaaaattttacacctactctaccaggcctgtgcaaggggctggtgacataaagataatcttggccttcaaggaacatagagcccagtggtaggagacgctggagaacagtataatggggtaaatattttgaaagtgagaagttgcaggaccccagaaaagggttacctgtgggaactgggatggtgggacatgattttagcaaatatttcacattacaaatgtttgagctgagccgtgaacacaaatgctgagtggaatttcttggaacagattagctgggtgtctagtggggaagataagacaggatggggagaagccacattggacagacttcacctggctcttgggaatgagaactacggggccagggcatgctgtctgtgtcttccatgccaaattcttactgtatgaataaactgagcatcaggttcacccaaaggtgagctctgtgattaatttctatcatctttacttggatttcagcagcagtggcatcagtggtgctgggtaaagtatttggtaacaggggttgagggtagcaaaagactagccacaaaccctgattctactaaaggaagttggctacatctcataggaaaccttttaaaattatgtgtgacgtatgtacaggtccaggctgtcttaacaggggcatggtttctaaaacatgggaggtgactattccacttttcttttgtcttaatctacacaaagtatattgtgctctgcctgttaagaaggatttagacaaattgggacatgttttgaacctgggaagcaggaagcaaggagaacaaaaatttgtgtttaaagaactagagaactttagcccggagaagaggaagtgcagggagaaataaaaatctcttctcagatgtttggaaagcattcatgtggttttactgttcccaaagaatagatgtcataactaatgactgaaaggtcagatgaaggcaagggacgaccttctagtggttggaaccacctgaagatgaaacaggctgttctttaaggtagtgagtccccattccttggagcgttctcgtaaagcctgggacaagggtcacaggattcctaaccacttcaggggccttttctaaccctgggagtccctgaaatcctggactctttttagctacaacaaactgaaagacctgacgattccatcccaggactctgggattatggtctgaagtctcatgagaaatacctcattttttaaccctctactttcttcctccacctccctctcttccaaaaagagcttaagtcagtccctgtgacagaaagcagaatagaacaaatgagttaagtcagatgtcagctgccacaacataaaagtagagtggatgcttgctgaggccccactcttgacaagatggaaccccaggctcctcaggggagccccagcagccctgcctgcaggggccattcccacgctgctcctgccctgtttgctgtctctcccatccattattataaactcgctgcttaaaatagcaaggtaaaaggagagtccctgccccagggtgacatctgggttctgctggagcttgtgggcacacggacctcacatccatcactgcaaagtttagaatataatctccaggaagtgctgatctagagcaccaacccataaaaggaaaaaatatttagtaatgtttggtctccaagctgttccttctttaacccattttcagggcccttcttgctgcctctccagtctggttcggaaagggttaggtaggccagtgccaagagctaatcagcttttatgactctactcattctgcctccagctagtgcctaactagaacctggcccattttacaggccgggaaactgaggtgcagaaacggaaacaacttgactggttcagctacccttgtatctggtgcaaatcttccaagagactctgctgggataactatccagtaatttgtgcaactgaagaggctagaagttcctaaaccatatttaaatattttatctgcccctgctcatgaaagaaaacaaactaatatgcttttgttcatgctttcattcttcagctacttctaagtcgcctactgagcatcggacactatgctaaatgtatttcaagtgctattttctttaacccccatgagataggttttattatttccatttaatatattaaggatctagggctcagagaggttccgcaacctgctcaagatcacacagctagtaagtagctggtgaagggctataatccaggctagtctgactcctaggcccgccatctttcctctcttccactctggcttcttcaccaggagttctgcttgagtgtggcagaaaagactagcacgggggccctgcctcccaggggagggctggagtgagtactcccagtgaggctaaggatggtgggaggcagaggggaggaaacaggacctacacttcggttgtcgggccggggtcttatgagggctaaagagtggcctacagttgagcctgcatgtcctctggtaggtggtagcagcaggtggaggacgcggaggccggccctgccttgtaggcttcaaaggccttactgtatcccagaaagtatagagccatcatcgggacgcacggttcaggaacagaatttacagagactatctctttcagtgctgtcagcagccctgtgagatggggagagtaagtactattattattaacattaaagttagacccatgttacagatgaggaaacagaggcccagagacttgcccaatgtcatcgctcatgaatggcagtgctgggaattcaccgaatctgggtctgatgctccccttccttgcagggccaagcctgttctcggcaggcagcagcagcctctcatcatggcgccaaagatgcctctcccagagccttgcaacctgcctaggagagaccaaactcctctctgaaaccacagtatcccaggagcacagcccgtaagctaagcggctctcagattctctctgtgaatctttgagcattgagggaagagccaagaagccctttcgggaaaccatgggttaacctagcctccactgacctttctggagtgactcagtattctcagaagggagtttttttgttcttccagctttgaatttttgctttcattttagcagcacaaagaatgtgaaagagattaggttgctattaataccacgggtctatctctagatggacaactgatggggggaattgttgggggtgactgcacgtggagctctcttagcccttctgcaaatccagagggtgatggagggacactgagaactcaccagtcttacccctgcacccatttttaccaatggggaaccgaggcccagaggggcaggcatgtgaccaaggccacatctatgagtgaggggcagagtcagaaaagtccccagagcacccatgccccgagcccggctgcatgtggcagctttctgacttttcattttgacggttttgctcatagtaaagggtaagccattgtgtctgtgctgtgaaagcaggcgtccttcggcagtgactcgtcattgttcttgctctcatgctctcatggtcactctcgcaggagagaggatgctccccacaggagatctgctgaaagtgctgggaggtgcctctgggggtcccctgggcctggccaactgcagagctgggttccgcgactccacaagtgagccggatgggaagcctgccttgggaaagccccatcctgcttcctaaccttggcctgctcacggggctttgttgcttggcagattccgttctaatccttcctctgcctctcccttgctggataaatctcccctggcctcagttccctcatttgaaaatggaggtaatagcacccaccttttagcgttgttgtaacgattaaatcaggaaatacatgcaaggtgctggtacatagagtccactcagtgccctcgccattctccaaacagggcagctgagttctctaagcatgcacagcatcaacaaaaccaagccaaggctcagagagactctggtgttcatcctagtggctcagagctcccagatttgtctcctgcaagtaaaagagactcagtcctggtctttgctgtggacagtcccaggtctgtgctgggcttgccccatgtctgtgctgtgctcagtcccaggtccgtgctgtggtcagtcccaggtctgtgctgtggtcagtcccaggtcagtgctgtggtcagtcccaggtccgtgctgtggtcagtcccaggtccgtgctgtgcttgccccgtgtctgtgctgtgctcagtcctaggtctgtgctgtggttaccccatgtctgtgctgtgctcaccccatgtctgtgccgtgctcagtcctaggtctgtgctgtggttaccccatgtctgtgctgtgctcaccccatgtctgtgctgtgctcagtcccaggtctgtgctatggctgcccaaggtctgtgctgtggctgcccaacgtctgtgctgtgctcagtcccaggtctgtgctgtgcttgccccagatctgtgctgtgcttagtcccaggtctgggctgtgctcagtcccaggttggtctggtttcaaagccccagttctttccactatccctgtactcatgatgactcccccaaaacagaggtttttgttccacaggtgagacatgaggcctagtgtggaatccctcctggaagagagccagccacagtgtctggccaagtaggtatttgtgctgtgctgaacaagtgggtaagtgagtgactgaagggggtacagccaccccccagtgtgtggtggaagccccaggattctctcctgaaagtggatctagattgaagggaattgtgcaggagcaggaatggtgaagggcggagatgcagggagaaagcctcggtggcaacagaaaagggaggatgaggaagtggaagtcacttcccccaagactgtgtcccctaaacaaagtcacgtttcgggaggctggccctgagaaccccgacaatcctggggtttgcacctctgtgggaaaccttcttagggcccgattttctccagccctgctctccgctcctgtggagctcgtataggctttgttggctgggggtgccctgggaaggagccagcacctgctcagaccaatgacaggaaataagcctaaacatctccccaggtttcctttccagcttgttcacttcaggaattctttttttaaaaataggtccacttgaaaaaattttttcttcttcaaaatatgtacaattgctcaatcggaggcagttcaaaggcaccgagaatagcagcaaagtatctgagcctcccatttagcgcctagcagatataaatcttgcccagttctgtttgttccaggctgctcagcagcctcttccctgagtcactcactcaagagtgacatgagtcatcatcctggggtcaaggaccacacggcattctgggtctgtgagatcccataaagggcagggcaccgaggggtctccaggaagacatggaggatcaggaactgtctcctaggccctaggcttggctctgcctccccacatgggtgactttagagagtcactaagcctgagaagtaggtggatttctgggcccttctaacttgtactttggaggaatctctttagtggtgcacaggagcctgcttgttccagctcataagagtctaatgtaattttcaagaattctgtgaactggtggttaaacacagacattattaaaaaataaattacatgaactcacattaaacaaaaaggagataaatactcaaaataactgctttttaattattttactacattttactattatctatgctcttctgaagatttatttctattgtctctgcatagcggaaactatataatgatttgctactgcccatctcttctcagttccatgatcagtgagggtgagttagtagcttgccattggtcatagtgggagtatctataccatggaaattggcaaacactatgtacatatcagggccttttccccccagagagctggccgtggaacattgccagcacaccactgagctactcagccccaggctccctgattcttgctcctaccagggtgcagaaggaacacagatgactttagtatcaccccaagatagcacagttatggagacttcattgccaattgtctttggacaacttttcccaagtggactatgaatcccttatcctcaacacatccctgacagagctcattgtttctttccctccccagcccactcctcctgtgccccagagaatggcactcaagctacaaacctagaagtcaccgtgactccttcatttctgtcaccctccacattcaattagatgactctgagtcccatcaatcctagttcagaaatgcccttcctcccatccctggcacccctgcccatggctctgtgtgacctgagtcactgcaacagcctcatttgtctccttacctctggcctggtcccttccaatgaccctccataatgataccagagcagtctgtctgaaacacaaattggatcatccttccccttcataaactccttgaggattgattcccttttaccatgggggggccagttctgagtcaagctcctagcccctctctcgaggctgatcccctctttcaacctttgtacaccttatgccccaaccacagtggaccaaaagccaacctccaaacatgccctgcttttttacaccctttgcatacatcctcctccttatacttgggctgccttctgtcctccttctatactttatgggttcctacttgtcctccaagacccagttcacatatctcctccttcataaacccattcctcctcttcacctcaggaaaagttactcccttcctgtagtagtttcctactgcgtctgtaccaaatttccacatatttggtggcttaaaactgcacaaattcattatcttacaattcttgaggtcagaagttcaaaatccatctcagcaggctaaagtctaagcatcagcagggctgtgcttcttcaggaggctctaggggagaatccatttcctgccatttccagctttagaggctgcctacattcgttggctggtgacccttttttctccatcctcaaagccagcagagtcgctggcatcttttctcccctctgatctctgcttcccccttcacatttccttctcctctgactttcaccgtcctgcctccttataagaactcatgattacattgaacccgctcagttaatccagggtaatctccatctaagtattcccaatttaatcatatctgcaaaggcccttttgccatttaaggtaacatcttcataggttcctgggttaggatgtagacatcttggggaggggggagtattcagcctactgccctatcctcccagggtactttgcccagaactcaacccaactagaatttgaacatctcaagagcagagactctgccttattcatagctttatgaatattcttataatattcatatttttatgacctgcctccagtacagggtcaaacacagaataggcattcactaaatgtttattgagttaataaatgaatgacaccgtatttctaaaaagcagagaagaaggttttacataggctgggtgcagttgcccatgcctgtaatcccagggctttgggagatcaaggcgggtggatcacttgaagtcaggagttcaagaccagcctggccaacatggtgaaaccccatctctactaaaaatacaaaacttagccatcatctgggttgctatataagcaagtgggtggccttgcctgccctcattctcattgagcttccccaggttaatggccaagtttttctctctctcgatgatgtacccgggtttcatgtcttctctgccacacagatgtgcaaatttctcccatagtattctacaactaaaacctcacaaaaggccagggcctccttctctgacaccttcatgcttctgttctgccatccaggagtaatttgcaaagtgaattttcagattaacttatcaatggctcttctagctttaacctaagcctaacagaagaccacagagcagccccaccagcccctctggctccgcttggaatgctgaccaaagcatttcctcaaacagttggttatgtgtgttcaaatgcggcagcaccctcgtgtctgctgctgtggtactctggaaccacctccttcctgacagagcagagccgggaggctttgcaaggtggtcattgcctttaaacccagacctggactcatggcttgattcctgctccagcaaaggcacagactctggtattaggggtcctggcaatccagcacctgggattgcccattcccatgaagcaggcctctgggaaatgtaccttatttcaggtagaaggcaggaggcactgtacccacttgatgggatcgcactaggccttgatggccttggttctttcagaagccaacatgtgggctgaatctgagccaacggcctcttccttggatctcccggcctctgaacctgaagatgcccttttcttaggatgggagcaaggatggataaaggcaagctggtgttttgtccaggcccagagatctgtcaagggccatctagaccaccaggaaccagaagaggcaccctattgccttggattctttagaaactttgttccaaataaaaataaagcttccttgacttggcaacaccacagcccaataaataaataaataagcaaaaaaagaaaagaaaattaacacccagttcccagtgtgcctctctcattcagttcctcctacttctccatcatctccccttcccttcctagttttcttctaggaagaggtcatcagggtctattaggaacctgtaggaatacatataggaatataggaatatatgtaggaactggtttgggaaagtcagaaggaaaagatggcctccatggtgcctgcctaaatcattcacccattctagaaaagcttgttgagtgcttcctatgtgttaggtactgtgctgggcactggggctctggggtgtgtcctccaaggccacctcctccaggaaggcttccctgacctctcctggaagctatattctcctctggtctatgacagcactgtgtggctatcccaatctgccaagcagtggtttctgtttctcatttgcaaagcctgagggcagatagctttcttttgtaacacaggtacagagaaagttctcaatacctggtggatctcttcttttgaaagcaaggactctaggaatcaagcctcacttttcacatggcctactacacacccagcacaatgtagatacgctagctcttgaaccatctcaggtctgtgagaaaggaattacttgtccattttacagatgaggaaatggagccttagacaagcaaagtgactcgctctaggtcacacagtcagaaggcagagtcaggattaaacactgggtctcctctgcccaaaatgggatgtttggctcttccttagagagagcttattcctatgcttctctaatcttagcaaagacagaacaagggtattaggagatgttttttgatagggcagtgctcttgatcattctagatcccagctcttcctcagggccagcacagccaacaagaacaacagcagccgagacgcagcccctctccgaggaactggaagtccttctcacggcatcccctggggtagacaggaagcagctgcgactgtgatcatctaagaccagcaggagagagtgttcttccctgctgggatggagcaccccagctcaggtccccgcctcctgttcatctccactctgggaatcccagttctccaaagccatggaaataggcccaataaccttgggctgggctgctgggcaaagtctggtgtaaagcatgctacagaaagctacagcaggattgagataggggttcagggacagggccttgtggggagtgaagagcagactgccatgctaactgcctgtgtaggaatgagttccttcaccattcaggcctcagtctctccatctcaatagtaaaggctgggctaacttgccagcctgagccctgctttctgccccatgagttcaagttcacgttgcctattgaaagcagtcacacagtaggaagttaggggccttcctggcatcccagggctggaagcagccatcacatccccctgatcacagtgattggctggagggtgagcatgtgagctgacaagaaccaatgagatgcaagaagacattactgggcatcctgggaaagccatccttaactgcagccttgagttccagagggtgaaagcagaatccctcttaagatgatgaagaagaacttgtctaaggatggaatcaatgtgagacagagcacagctaagagccagaaagaaactaggtcctgaggctatcttctcagatcctgatcaagccatgcctgatatccccagccttttctgttttgagaaccaatgaataccccttttttcttaagctggcttgtacgagcttttttggcacttgcaataaagagttccaactggtgcaaacagcctatcctttataatgctgcctgtggggactttcttggcaccaagtcttctctcacctctctactgtgctgcttacctaaccctaaccctaaccctaaccctgagagtttaagctgggaactcagatctagagttgatgagcttaccctaagttattccctaacttagaatatcaccatgcccttttcctcagaacctgttcctctttctgcattccctgctaccattggtgggcccagcatctggccagaaaccccagcccaaacacagaaccttctcccacctctccaggatgcctgtccccacttctttttactaatacacacatctaaactgttagggctccagaggagtgactcggtttgaccaacctccatgttcctgcctagacgatagactggtacacaccaagatatgtttgttgagtcaaatttcaaccttcaaatgattttcaaacatcattacttcctgggggcgaccactccacctacctatccctcagctcagagctggataggctctcactctcaaccctccccagaagagcagaccccaagaccgggacaatgattggctgtgtgaacaggctcgcagccctgtgcttggaaccccagcaccagagtttagggtggagactcccatgtgcaggacaggaaggaagctcacaccttgccgactgaggccagcagcagggtgggagcagctgtggatcttggccagggtctttttttcaccaatagactctgagctgaactgcaggatggtgggtgtgtacacaagaagacacgtgataaagtaaaagtgagcagtcccttggttatccagatgtatgcaaacagctgcattagctgagtctttagacccaagttgagaacaggttatggtgaacagtgatatgcaatggcaggggtgggtggaagccgggagggtagagcctgggaatggctctcccaacagcaagctttggtgattagaggcccatgtatttcaaggtcctactgcttaaatgggcatgtgcaactgtgactgcctaatgatatgagattggaagtaaccatagagaatttctccgcaggggagtcatttttccaccatggagaggtggggatggtctgggagtaattctgaggcattagcaggagagaaactgacatttattgtaccaggtgctctacctgactctttacatcctttatcttatccagtccttacaacagccctgcatggtacgattattcccatcttacaggtgagaaaattgaagctcagaaaggtgaagtaatttgtttcagacatcacaattactaagtaatgttaacagggtttgagctcaggggagcctgactccaagcccagggttctgctcagtataccataatgaaggcttctaggtcaatacagagccaggcgacagcagcagcaacaacttcaaccaaaaatgaaatgctaacacaggaccagaagaggtttttctggctaaggcttcaccagtttgtcatcgtggagaaggtatcatccctaacaatcagatttacctatgttctttgttaacctgcagtttgttatacatgcaatagctctgcttaagttaactggtaaatagcatagagtttatccaacgggttaagctgagtcattctcgtgaagtattttcttgtttttagaaaagactgagtaaagagagctctgagggcaggttaaggccagggactgcctggagatgcctcagcagttttgctggagctgttctgggctgtgagtgggcaggcaggtgagcagacccccttcctggcccaggttccacaaggagcataggcactgggaaatcactgggttttggcagggttttcttggatcacactagcaacattaccaaggcctgagtggagctcctgcaccctggggaacattttcccagggtagcccccaggctccttaggtcggctcagacacccctctttcctgtgcccacagttggtatttcctagttataaaatgattttttcattaatgctatgatagaatgtagaggaatgtagatatttttaatatgacaacatatgtttatagaacagaagttttttttttcgtttttttgtttttgtttttaaagcacctaatttggagtcaccctggatcccagaagccccaaagtcctgggacattgttctcgtggcctttcatctcttttcctctgatcttctggatcccctacacagggcccttcctctagggttggcagagtttgggaaaagcaaaggccttctagggccctgggctggaatgctggctggggtatggctggcaggctttgtggttgggactggttgggagcagcagctctgctctgctcagcctgcaggtcagcactggaaggcccaagttgggcaggggccccaggacaggagggagggagccgctactcaatgctttcctgatatcctcttactgcctcagttacctcccaattccctactcataaaaatctagccatcctgcagccctattcattctacatgtccagatgagaaaagctgataaccagaaaatcgactcctggggtaggtggagggtggttctcctatgaagtaatccatcttccacacagctggaattctaaaacataggtgtggtcgcaggcctccctcaagtcaaacatttcaatggctttctgtgtgctgactcccaagtctggctgcttactaaaagcacctgaggtgcttgataaaatgaagattcctacacccttctcagatagactgactcagaatatctgggaatagggcctgggaatctgtatggctaaaagcccctaaaggggaatctgatccaaagaccagagctggagaagccctcgtccacagatgaagtccagtttcctgggcactcatgcaaaactttctgctctgagactgccaaacctctctgttttttctccagccactaacaccaaggtatcctgcaccccagcctcacctaatgctcactttccagaatattccacgtgctatcaaacctcagtgtcactccctctgcctagaaggccatccccccatctgtctccatgaaagaccctactcatccttcaggagccaccacatgattctcaccagattaaaccctctgccccatttccttttagcattttaaattgtttagttggaaacatagactttaaccttctatttgccactttctagctctatgactttggctgttgactttcaatgtcctcacaaattattatgaaaaatattcaaatttgaaaagtatgtaaatgtatgtaaattagatatacagtgtctagcacaaaataactaacagaatggtaacttttattattattattcctatattatgatggcattcctctaacacagagttcaacaaactatggcctttgggccaaatctgaccaactaatggtttttgtaaataaatttttatcaaaatacagcacaaccattcatttgtatattgtctatggctgttttcatgctatgagggcaattgagtagttgaggcagacactctgacttataaagccgaaatatgtactagctgccttttttcagaaaagttagccaaccctgctctaacataattgcaattatttttttatagtttcgtctcccctatttggctgagagacactcaaggatcttcatggcagactcctgttcatccttttaaactaagtctttctcatctttgtatctctaacatttggtatataattagggcttggtatatgttaaattgaagtgaataattctttaacccagtttaaatgcacacatctcctgaaagccctgatgggaagatggggtaagtgccagcagacctggctctgaggctgcctccctcctggcttcagcatcccacagtctcactgcctcccaccacccaaaacccagcactctgtgctttgcagctgtaatatttcccctgatagagaggggaggaagaagtccttcaaaggttagtatattcccattatccaagagtgtacaaatggatggtctaatggtccccatggtccttacagggggcaatttggtggacccatttttaataaataaactaatggattggtattttttctctggagatctatattttgtttagtttcaactacccatgaatttgcattcctgacaaaagctccttttgagaagagaactaggatttccaagcagtgagaccatttctttgtgagctgtttatgaaactactctgtgaccttgggccagtcacccgcctctctgggcctagctttcagtttctgtataacaacttccagacttgactccctggagttctagccagagggatgaaccaactcatggtgagtgaaaacagtggcctggcaacaggcagcttgacagagtgtcttccctcttccatgctgcagtagcacattccctgtcctccccagcaaatacagcgactcatttctactgccttttcttgaggcttaaggaagatactttagccctaaagtagatcttcagaagataagaaaatgccatggtgtggaaaactctgtgctggatgaagtggaaacactcagctctcccccgaggccagatgaaaagcacatggatgaaagccaaagtccatcccttccttgagcctttgggagcagcagtccaccctctctttcagaaagtagttcccccccttacccttcaccctccttgcagacacccccatgggataaaatactgagcctgcaggatcctggttatctgggggcaaatcggtgtaactgtggattgaactgacttttattgatttcccagcaggtgatttataactgcctgcttcctaaaagggcttgtggccagatggcaataaaaacactcagaggccaagagagttaaaaataaatgctgaaaaagagagcagaggaaagagggagatagacagctgcactaaccgaggtgggatgactgctcagtctggatcacagggatgggaatcttgcttttcagttcctactgacataaccaattgagatcagcagcaccttgtttttggcttttgcaagaattgcagagcaaggagtagctacatcttgagcttccaaaactaacccttagtccaacagagaacaaaattgagtgagattttgcattttagaactttataaagctcacttcacagagggactcctcatacaactatgtcaccgtactgtttacacaacaggatctggaagtactttaaagccggcagtgtaaatcaaattctaggtgttatgtacatgtctgagtctaatggctggtcatccaccctccttgacttggctttagagtagtccttaactaaaacgagttctagggtcatgcaaaaccatgcacaaggatcctttagcttagtgaaaataggcagtgctttctaattctggccataggtcactgtcatttggtggtcacggtgaattggttatttaacaaattctgttttcactagttgcaactaaccagaaatcagatctctcaaaggaaaaccaagaaggctattgctatgggcttaattgtgccccccaatactcctcctagttcttatgtcaaaatcctaacccccagtacataataatgtgactgtatttggagacagggcctttaaagaggtgattaagtttaaatgaggccattagaatagaccctaatccaatctgactggtgtccttataagaagaggaaatttggatgtagaggcaccaaggatgtgcctatacagaagaaagaccatatgaggacacagagagaaggtggccatctataagcaaggagagaggccgcagaagaaaccagacctgctgataccttgatctgggacttccttagaactgttagaaaataaatttccattgtttaagccacctggcttgtgatattttaatacagtagctctgacaatctaatatagctattgatagaatctctcagccatatcagatttaaattcaagtctgtttcaaacatttaatctttgaaatagggatcaatacattttggagaataattgctttagtatttttccaggctaaccacaaaactcctttcagaacctttctaatgaaataaaaattctctagactaggtcccaagaattctacctttgaagaagtaaaattatctctatttgcaggtgatatgatcttatatatgcaaaatcctgaggaatccactaaaaaactattaggactaataaatgagctcagcaaggctgcaggatatatgattgatatagtacaatcaattatatttctatacattagcaatgaacaatcaaaaaatgaaattaataaagcaattctattcacaatagcatcaaaagcataaatacttaggaatacacccaacggctggccgggtgtggtagctcacacctgtaataccacaactttgggaggctgaggtgggtggatcacctgaggccaggagtttgagaccagcttggccatgatggcaaaacctcatctaaactaaaaatacaaaaattagcagggcatggtggcgcgcacctgtagtcccagctactcaggaggctgaggcatgagaatcgcttgaacccaggaggtggaggtttcagtgagccaagatcacaccactgcactccagcctgggtgacagggtgagactctgtcttaaaaacaacaacaacaaacacaacaacaacaacaacaacaaaaaccagaaatatacttaacaaaataaatgtaaaacttttactctgagagatatgaaatatatttgaaagaaattaaagccctaaattgttggaatgccatctcattccaatttcatatggaaacacaaggaagcaacaataatcaaaacaaactaaaaagaagaaaaaaattatctacacatcccaattgcaaaacttactataaaactatcgtaatatagtatgatactatacactatacaagaagagacatacacatcaatgcaacagacttgagagttcatacataagcccttacatttatagttaattgatttcaacaaggatgccaagacaattcgatggggaaagaagtcttttcaacaaatggttctggaacaacgggataaccacatgtaaaagaataaagttggacctcttcctataccatacacaaaaattaactcaaaacatctaaatgggagagctataactatagaattcttaggtgaaagcatgtgagtaaatcttggtgtccttggtttagacaatgccttcttagatacaacaccataaatgcaggcaacaaaagaaaaagtaaataaattggacttcatcgcgatacaaaaaattctgtattgaaagtgatgctatcaaggaagtaaaatgacaacccacagaatagaaaaaaatttgcaaatagcatatctaataaaggacttgaataaagaactcttataatgataaaaagacaagtaatacaatttttaaatgggcaaaatatttgaatacacatgtctccaaagaatatatgccaatgaccaataagcacatgaacagatgttcaacgtcatcaactatcagggaaatacaaattaaaacagcaataaggtaccactttacacccatgagggtggttaaaataaaaaagacaacagcaagtgtcgactaggatgtgaagaaactagaacccttatatattgctggtagaaatgtaaaatggcgtaaccgctttggaaaacagcttagcagttcctcaaaaggttgaacataggattactgcatgatctaccaattcttctagatatgtacccaagagaaatgaaaatgtatatccacataaaaacatgtacacaatgttcatagcagcactatttataatagccaaaacatggaaataaactaaatgtccataaggtaattaatggatgaataaaatgtggtatattcatacaatagaatctattcggtcataaaaaggaatgaagagccaggcgcggtggctcacacttgtaatcccagcactttgggaggctgagacgggcgaatcacttgaggtcaggagtttgagacaagcctggccaacatggtaaaatcccgtctctactaaaaatacaaaaattagctgggcttggtgccgtgcgcctgtaattccagctactcaggaggctgaggcatgagaattgctttaacccaggaggcgaaggttgcagtgagctgagatcatgccacttgcactccagcctgggtgacggagtgaaactttgtctcaaaaaaaaggaatgaagtaatgatataagttttaagtttcatgctaaagtatgaaacttaaaatgaatgaaaggatgaacttgaaaatattatggtaagtgaaagaagccagtcacaaaaaaccatacgtattattttatttatataaaatgcccataatagagaaagctatagagatggaaggtaaattaatggttgcttagggctgagaggatggggaaatgggacgtggctgttaataagtgtggggtttctttttggatgataaaaatattctggaattagttagccatgatggctgcacaactctctgaatatactaaaatccactgaattgtacactttaagtaggtgagtcatatggcgtgtggattatattttaacaaagctgtttaaaattttttctaacttccattaaaaaaaaaagagaaggaagctagctttggtccttagtgccttgtgacctctctgggcatagcttcctcaaacataaacattagaaattaagctcgatgatttataacgtgccttccatctctgaaattgctgaggatacataatgtaagaaaacaggttgagggaaagagatagattatgtgtctaggatgggctcgtgtgaggagaaatgaaggaggaggcaacaataagaagactaagagaaatagagatgaagggacagggacacgggctcagagagacagacagagacatggagacaagactacaccccaaaagaaagacagactcactgggatgaatgtgcagattactcatctgttcttccatttaacaaatatttacagagcgcctaccaagtgccaagctctgtgcagtagtaaaccaggtagaccagggcactgagctcagaggtaagagacatagcagtaagcaggcaatttgcaagcaagcacagagagcgagagctgggatgcagtaattcaagatgctccagaagtgcacagatgcaacatacaccccacaccacactccacatgcacaaatgtcccaaaggtagactcatttttgtagggagcgccattcctcatctgaggcatttagagttctgctagcaaagacattcaaataaacgggtttttacaagtatgggcacaaatgggggtgacacctttcagttctcaccctgaagtctctataaaatgaggctgaaggacaggattcatccctcactccagagcttcccagtactctttccccctcatcgggagggactggctttggaaacagagaggaatgtgacctattacagccacaccagcaccactcctctgggctttcagctggaaacttcccagaacacattttgttccaccctccttccatcccatccagacctggcgacctggcccaatgaaggcatcacatgttgccccttcccctgtcttgtggcttctctgctgctgacaggcacatgaaagggaattgaagctcaacagaaaagtgactgcttcctgcacggtgtcggctccctgcctgactcagattcagccaactctgaggagggaaggcaagggacgtttctggatatctcttgcccgggtccctcttctcctaactccagatttagcgagagtccaagctacacaatattcctgaaatagccccaagtcacatcctaagatgggggttcatcccctcatatgaaggattctctttggagaagatgttgggggctttggacgccgtgcactggcacacgaataggaaacgcagagtgacccggagcaggaaggaatgggcaccgccctgcagattctgggcaggctgcaccagtgctgggctgggaaacagcccctgggctccctgaagatctccctggctgtgcaccatttggagcagcagtgaattaatgtgattcaggctccaaaaatagtagccagagcatctaaaattgctttccaccctggactgggccagtcccctgggaatgtcagcatttctaaaatgtccccattcacccagagtgcctttgtcagaccccaagtagaatctgggccaccgttaagctctcctggttccgttggctcctgcccggttcccctctcctgtgtgtcacgtgcactgcctcccaaacaggaaatgctaattcatgcctgccacttgctgttaccaggtccaagaactttaaccctgcaaatggcttggaagggcagaaatggtcccttgcagaagtggcctgggtggctctctatcactgagttgggatttaattcctaacaatgacgactggggaagcaggtcacctgaggaaccctgagcctctggtctgctgctgatgccaaagggagtcatttccacagtggcttgtctttctctgacaaaattatttggggatctcagggaatttcatcatcatgaagacttgtcactctaggcctacctcagtgcttttgcacatcctgtactctacgcaggaaacaccatttacgccctcttccctgactgacaaatgccccttcatcctcttattcagcgccttcctaagagtgctgcggtctttactaagtttgtctgcaatgaatgctctggaatggccacctttgcccaggttacactcccatgcctagagattcacaccctgcattctcctacccactgatcgaccacgactctcagctgccttattcatggacaggagtgaggcaaggaacaagcctctcccctgcctcatggaggctggcctcccatctaacaattaaatggccagagtctgtaaccactgcatggggttcctgatttaaatgcagtttgggaatctctctgcctagagaatcgtgatttgatctttgtgatcatgtcctttagttctcaggttcttagctgtgatgctcgtactgcctcttagtggcttcgctttgcctccctaagagattccagaagcgcaggacacagaaagtgatggaggagtgaggagggagaatgagttagtctacaccttggtttctccctgtgcggtgggagctaacggtttctccgtcagaatggttgagaggatggcatgagatgcgtacatgactcagcacagtcagtgctttggggggcagctgcattttcgcccatgcggtccccagtcccccttcttctggcgacagcagcacatccatcatacttgtgcttgggatgggggtggttgaccccactgtgggattggagctatgacactggactggccccacagaatatcccatgctcccagctctgggttgtaattgaggaatgagcacgtgactcagaccaggccaatacattcagttcggtgacttctgttggaactgttgggggagttcctgctgcaagcgttgctgaaaggagaggctgggaactgcaggtgccacagtgccaccacacaggagaggtcacctgagaatacatctaatgccaaggacagctgagagacaaggggatgagaccgtggatccagccatgtccgagattgccctagaactctcaatgatatgatccagaacattctgctaatttgctaatctaatttgaatccgtttctattctaggcaaaccagaatcctggcaaatgccaagctcaatatgtttggaggttcacccttcccacggccattgctctggggcgagcggtgttccttggcctctgcagagacgatgccacagctcatctccctgtcctcagtctctcgttcttcagtcttttactgcactgactgttctcaaacacaggcttagaagatgccttgactccccactgcctggagatcatgtcccaacttcctcagatccacctgcaaagctctacatctgactctaatttcctttgtgcgtctctcccatgaccttcccctctgggtccatgcatactctgtgccccacccatattaacctcttccccactctgaaacgctccctccactctcccaaccctgtacttttcctgggaagttcctcacttctttcttacctacctgccagatccacaactaccttctcttctgagaagtcttcatggatggccccagactgagtcaatgtctccttctcctgaatcaatgtctcccttgtacatactgtagtacctcttggtgtttatgacttgagagtaatttatacattttttttgagagcagggagcatgtcttactcctttcaggatcccctgggatccttacacaagatttgctcactctagaccctccctgaatttgctgacacaagaccttggcttccagctgacaaactctgactaccccgtcccctcccctcaaccatactctaggagaggggtgcctaaactttgggtcacatttcctcttcaccagtaaacttcttttttaaaaaattatgataaaatatgtgtgacatatgatgtatcattttaaccattttgaagtgtacaattcagtggcattaagcacattcacaatgctgtgcacctatcacccctacctagttccagaactttttcatcatcccaaatggaaactctgtacccagtaagcagtcactccctgttcctcctttctggcaggccctgccaaccacgaatctgctttctgtccctgtggctttaaccggttctggatagttatatgaatgcaaccatacaatatgtgacattttcggtctagcttctttcacttagataatgtttttgaggtttatccacatggtagcatgtatccatacttcattcctttttatggctgaataatattccatcattatctatctctctatctgtctatctatctatctatctatcatctatctgtctatccatcccacattttgtttattcattcatcaggtgatagacattcgtgttgtttcctccttttggctattgtgaatagtgctgttacactgtgatacaacttctgtttgaacacctgttttcaattcttttgcatatagacctaggactggaattaatgggtcatatggaaattttacatttactgggaagctgcttatccttgctttctccaagcctcaacaacatgctgggtctatttaactgctttcacgctgagagagcccaaggttcttagaagggagcgatttcatcttgtcgtctcctgatggcaatccctaaaggatgttcctagtttttaatactgccctcttgctgtttagagctttcctttgtctaagctatttcagacatattatttaatttattcctcacagaaatactgtaaggaggaaacgattacgtctgctttttgatgtggaggctgacagattcagaggatgaagtgatgcggcaaggtcacacagccattaggagcccagctgagactgaccccagcccagtgccctttccacgccaccacagcggccctctctcaatttgcctctcttttcaaagtctttgtaaaatagccaccatctgaaatgtattctcagacccaccattgtttagaaatgccctcttggtaggcaactggttgatgctggcatggacctctgcaaacactctaccagttggcacctcatttgtaatcgaagctttttcctggggcagattctgcctgtaccaaacagaccaatgtttaccttttctgggtcttctgtcaccttctgcaatcctgggttaatgttcccttttgatgctgctatgagtctaaatctgagtgtgtcccacaagctcaacctcagctctctaaatttcctccctgttcttttgttcaacccaaggtcaacccaagagcttccccttccctttctcaggaagaaactatcccttggaccaaggggtcccctgacctctttggagtagaaaagaggcacaatgcccttcagcctgacatggtgaagttgtgtctatactgctccttggaagcttccaatcttagtgtcctagttctacatgagaccaggagactgtagaaataagcaaaacaggcaatgataacaataacaacattctctatccatcagaagcatagagctttttaaaagcatacgattcagtggcattaggtacattcgcaatgttgtgcacctaccacccttatctagttccagaacactttcatcatcccaaatggaaactctgtaccaatgaagcagtcactccctgttccccttccccccaggccctggcaaccacagatctggtgcctggtgctttaggcatatttactcactcaatcccccaactgccctatgaggtggatgccactttgcagataaggaaactgaagttcaatgtgatgctgtgacctccagagtcacagagctaatgggtggccaaacagggattgaagccgtcagagcccatggcttccccattccagcccactgtctgcctctcaggcagaaggtttgtgagctgaccttgctcactgagagctttccttagcagttctgcaagcagcaaggactctctagatgccacgtgatccatcctgtgtccacccaagtaggaataccactaaccacttatcccaaagttgtatagagttctgtacaactccagatctgggtgatgttgtcaggagctctgaaaagaaagcttatgtgtttcactctatttgggaatatcagcgggagataggtttctgtcttgcaggacatctcagagcctttaaaagtaaatgtgcagtataaatctgcaagaaggggtgaaaggatataatgtttcccaaatttatttgaccatgaaacgtttttccaaggagtatctcaaagtgtcctctttaaaactccactctgggccaggcacagtggctcgcacctctaatcccaacactttgggaggctcaggcaggtagatcacctgaggtcaggggtttgagactggcctggccaacatggtgaaacctgtctctactaaaaatacaaaaattggccaggcatggtggcgcatgcctgtaatcccagctacttgggaggctgaagtaggagaatcgcttgaacccaggaggtggaggttgcagtgagcagagattacaccactacactccagtctgggcaacaagaatgaaactgaggaaagaaagaaagaaaaagagagagagagagagagggagggagggagggaggggggaaggaaggaaggaaggaaggaaagaaagaaagaaagaaagaaagaaggaaggaaggaaggaaggaaggaaggaaggaaggaaagaaagggaaagaaagaaagagagggaaggaaggaaagaaagggaaagagaaagaaggaaggaaggaaggagaggaagggagggagaaagagagagaaagggaaaaagaaaggaagaaaggaaggaaggaaggggaaggggaaggggaaggggaaggggaagggaaatctccattcagaaatgccctaaaccctcttaggttagagggtgtccagaggtgagagaggacagtaattatgtccattggccctggagctgggctgcccgggttcatatcccagccctgccatgtgaccttgggcaagctgtttcatctttctatgcctcagtttcctcacttgtaaaacatggataataacaatcttgtgaattatgtaatataaacttcttagaacaatgccttttgtgacatagggctcacaaacattctaataaggtccttggggccgggcgggttagagggggcagtgagagggattatgttacctataatgcataaaactgtaaaactccagataattcatgaaagattacacagatagcatggtttcattgtcctcagggagggtcagtgagttccagtgggaggagaaagtgctatgcagatggtagttagctgcttgatccatcttcctgggtcttttcaagttcaccaggtctcctctacttagggagtgcccgacacctcctggaggcccctcaaattctggtgcctatgagtttcaccacttccaaggaacagaaatcttgtccttttgtcaccacccactactcctgtagggcatactcatctgcccccagagctggagtgctgggagaagctggccctgtagtgtgagggcagagtggccaggctctagcggctgcctggaccatcatttccaatctgagcagtaaatgtctaacgcatgagtcaagtgccttgttaataaaaaagagaataaataggcattccctttagcagtaaatgttttttttaaaaatacaaccttccattaactttggacctgatgcccattctaactgtcaccaaaggacttgaatgggattgtagaaaataaacaataacagctgactcttcaaacacacctgcagtcctcctccttgtcactgacagtgcccagctgtcaattattgctctgagatgggctctatcatgcaactattgggatgaatcactgggccctgtagggtgaatggttcacagatgaggaaaatgaggacttggaaagaagatttgatttgctcaagagcacaacatgagttgaaggcagaaccaggcctacaactcaggaccactgcttatacggtctcttcatttcagcttaggaagtggcaccagggacggatgctggaagaccttgactgcccttaaacctgagaggtttcattcatgcatgcatttgttcattcatttaatgtatctaccaaatacctgctacaaactgccatggtgctagcttcccttaatacctttctataaaaccataatgatctaaccctttttgaaatcttattgtcccagctctactctctcccggcctgaaaaactccaagtatgagtttctatctgttgatgggctgcatgcactttgcaccaagggcaatatggccttggctctgccactttctagctgtgtaatcctgagtgaactactcagcctcacaaagtctccattttctcatcagtaacatagagataatattataacctgtatcacaggatgctgcaaaaatatgagataatgtatgtaaagaacttaacatagtatttagctggtgctcaataaatgacagtaatttacagacagaaatgacagaaagttacagtaataagcacattattattactcttgtcatgtgaaacaagtctctggagattcagcaaatggaatcttcccctctgggactctaaaaagtcaggctctctttgttcatgtgcctaagcaacttttgtgctttataaactataggaatcgtgatatagggacaacttgccaaatgttttcaggtctaatgcaacagatccttgatgtctataaccaaccgtatctttttttcctttctgggaccagctggcctgagaaatagtcttcctctaagtctgataaggtctgtgaaccccagacctgttaggaatgttggctatacatggagataactgcaaggaaatggggctgccctccaatgtattaacaaggtttaaaaaaacccataaacaatggacatggttagttatctatggaagtaacccaagaaattctctgtatatggggttgcagagttgagaggcttaacagacatctctagaaggcaggacagaaagacaactataaataagtgggtgatgacattctttgaagacacttttactttaagcaattttcccttctttagtaagaacccctatatatgagggatggcttccccatgaccacatttataccccacaatcctgtcccctggccatgactgattgaccctgatccaagctggacttatcagattatttctttcaagaacttagagaccaggagcttctggaacctagtcatactgggcctgtggcctgggcagtgatcttcagagtagagtatgtcatccagggaatgcaggatgacttggtggagtataggaaggaaatttaaaataaaaaccttcaatttttaattaaaaatagtaacaaagtacacttccttaatatttaataaacagattggcagtggtgctggttcatgtattgaaaggccagttatatccagtttgtgagctgttgtatggggaattctacagtgttacggaactgatgtagcaccctcatgtatccatttgtttttcctgaagggtgacacagtttgtgtgtgcccaagtaagtaggttaataaaacatatttatctagttttaaccaaacctactatcataaaatgtgtatgcggcttaaaaggtttgtgccaaaaaaaaaaaaaaagtacaatgaaaatacttctactaataaagctaacagtaattctcaaaaaaaaattttacaaagtagtggataaaactgaaaatttaatataataattcaggaagtaaggatgtccctcttccacatgaggtatctgagctggttttcctctgccctccttccctttctccctgccctgccccctggttctctgctgtgtgcttcaggatgacacctatggaatgtataacttgggctcctttgcttgcaggctgagtttggccaagggaccagtaggggatgggaggagagagaggcctgggcctttcctcccttgctccagcaccacatctctggcagtgactgtgactctccttagctacagctcattctggatggaacctcttccctggctccagagctcactagcttctggtaatacgattttcttctctttccccttgaagaagcacatagaatcatgaccaaagaatacttatttagggaaagcaggaaaattgttgacactttaaaaaaaaaaaaaaaagcatgattttcaaaatattatttcatctttcttgttctttaaaaatttctatttttatgttttataaagtaacgcattagtacaatagctcatgaatatgatttataataaagaaatatacataaattggaggtgcatgctaaaaaaattttctctaaactaataagatgcaacatccaaaaaacttgaagacctctcctgtagagaaaaggctggcaaactataaatcatgctgctataaagacacatgcatacgtatgtttattgcggcactattcacaatagcaaagacttggaatcaacccaaatgtccaacaatgatagactggattaagaaaatgtggcacatatacaccatggaatactatgcagccttaaaaaatgatgagttcatgtcctttgtagggacatggatgaaactggaaatcatcattctcagtaaactattgcaaggacaaaaaaccaaacactgcatcttctcactcatagatgggaattgaacaatgagaacacatggacacaggaaggggaacatcacactctggggactgttgtggggtggggagagcggggagggagagcattaggagatatacctaatgctaaatgacgagttaatgggtgcagcacaccagcatggcacatgtatacatatgtaactaacctgcatattgtacacatgtaccctaaaacttaaagtataataataataataataataataataataataataataataataaagagaaaaggctggcaagttcctgctgctgggatctgaaagctgccctgggtcctgccttcctgaggcattgctggctacctaccttttcctttgattttctcaaataccttataataaatcctactttctcttaagttagccaacatagccttctgagatctggcaatcaaagaactttaaccaatatataggtgggatctgcaatttcttgtgtgctgggacagactatgtgaatatcacataataactaccattttatagagcatttttctacagcaaagagaaaggcttgtccaaacttcccagaggaaagaggcccttcctgagctctggaagagtctctctgctgtaggcagaggtggctcatcaggccacatcatagcttaggtgacccacccctcagaactttctgccttcttacctaaatctctatctatcaagcattttggtcattggaaagggtttgtctcctatcatatactggcacatagacattcagaattgcatacttggctgggtgcagtggcttacacctgtaatcccagcactttgaaaggaggctgaggcaggtggatcacttgaggttaggagttcgagaccagaatggccaacatggtgaaaccctgtctctactaaaaatgcaaaaaattatctgggcatggtggcgcatgcctgtaatcccagctacttgggaggcagaggttgcagtgagccgagatcgcaccactgtacttcagcgtgggtgatgcagcaagattccgttcccaaaaaaaaaaaaaaagaattaaaagaattgtatactttagtaatctcagtgctttagcaggctgaggcaagagtatcacttgagtccaggagtttgagaccagcatgggcaacatagcaagaccctgtctctaaaacaaaaaaacgtttaaaacattagccaggtgaggtagtatatgcctgtagtcctagctacttgggaggctgaggtgggaggatcacttgagccagggaggtcaagcctgcaagtcagctgtgactataccactgcactccagcccaggggtcagagtgagaccctgcctctcttgaaaaaaaaaaaaaaaaattgtatacttcagtctcttgtgagtttgattattgtgagtcagtctctacataagcaatcaactaatcaattccaggtcactaaccaggcttagggataggtccaggactctagaacatccccaaggtgatgctccttggggaagtctcttagaagccaactagccaggtttatcttgacaacacctagccttatcatcattgccttccaaactacaacggggaccagttagatctcaggtgggaaacaagaaagatgtcttaggtaagaagcccaggaagacattacattctttctaccatacccatacaagtcaaaaatatgacaagagagtccttggggaaacctgaccatttgggggcatccaaaatagaggactcccatgtgctcaatattaatctgggcttcaataataataattacttattgggtacttattcaggtataagtactttagatctagcaatccatttcataggtaaggggactcagaggttagatcattcgcccacgtcaaacagtaagttgtggggctgggatttgaacagactgggtgacctcggcaacatttacagacttttagggcacaaactttggagagccatagaaagtgactcaagacacacaatgtaggacatggcatttcttgccagtaaaaagcttgtgattctaaatttgtatttttccttctaaatagaggaaggaacttgttcataaacaagactaggagacctgataaagatcattacatactgaaagaaaccaagagaagtgcaaagtagagcaagcctagtggggaagctgctccagtgccctgccccgagagctcaggacctcagctctgagcagcagcactgggacctccagggctttgttcttataggggcaggaacaaagggtcaggcattatcactctgtcctgcagccaggtctataggccacagagagatggaaagagatggggcttggtggtctgatggttttggtttgactctcattcttctcatactagttactatcctccttgaatcagtttgttcacaaatacctcccttgcatggctaaagtacagatttgatgagatattgtataaaatgtgcctggcacatacaaacttgctcaaacaatggtagttcctttcccatatattttctcatctatctgtaagaagtaacccagaagaaaggagttaagagatcacttgctccctgtctggagttgcctaaatgaaacttctgtgaaaaaaggaaaattcatcgccgcagaaacttctagtcagatgcttgccttgtctaaggaaggactctgcattaaacaagttccccaccaggcatctctggagaaaagatgaggattgattaactggaaaagggaggagagggggtgcccatgggaccatgtggcaacccctgcagcctcggccctgcctgtctctcactagggcaggacacaagtcttgccaggtgcccatgggagaccagccttgcaagtgggctttagccaggccctcatagtggtaccccagagtgccacgctcttccacaccaagagaatggctatctgatggtgagttctgagaagtacctgcatgaatagctcagccctccctcttctgtttctctagggaattagctgctttcaggggacacacattctgctctgtttctccaagctttaatatttaaagagccctactttccccagtgggcaccccctagggctgggggataaatctgctcaatgcaatattagaaaacctacttgcctgttgatccaaacactttccaacaccagcttcatcagtcatacgggtgatattagtctctgaattcccaacaagccttaaagcttcagtgaaggaaagaggtgttatttattgggcctccttaaagacttcaccagacacagatgcccaatcctcttgagaggaagtccaccactctccttgcggtgtttttggagttgagaataggacccaggactgtggatggtcagagcctcaaacccagtgcagaagtcttcttgatggaatctctggaggggaacagacaggggctagaaataataagacctaatgtataccgagtgctaagaatagacagtgggctaagggatttagctttgcttttttttgggggggggtggtatttaactttgtaaaatggacactatcattacaggtcgagcattccaaatctgaaaaatctgaaatctaaaatgctccaaaatgcaagaatttctggccactggcaagacactcaaaggaaatgctcactggagcatttcagattttggatttttggatttgggatgctgaactgggtaaatatgatgcaaatattccaaaggccaaaaaaaaaaaaagtgaaatctgaaacacctgtggtcccaagcattttggtaagggatactgaacccatattacaggagaagaaactgaagcgccaacagattaggtgcagctcaagggatacagctggtcagtggtggagccacacggtcactccagggtccacactttccatagggacactgtgctgcctccattacaagatgtcatctccccactgtgataataagggaagagctggccaacactgagcccacctcctgactcagagcccggggttattttcaccacacctgtatgagcaaagtcaagaatgtcttcaggctttcttctcctcctgatgagccaggaagcttgggctctctggaaacaccctcttgatttgcttatcagccacagaactctctgtggcctctctgtgtcccttccctggtggccactctgggaaccacatcccacccctagagccaggctgtgtgcagtgtatagtctcatccctctcagcctctctcattgagcccattggttcctaaattcctgttggttttgctgggatgactcaacttccccaacaccctgcactcaccaatacctggattccaccaagttcatacaacccgatttccaccaagccgtggtggaatgacctgactcatttatacactatgctcacaatttttcccatgcctgtgttttacctatgcctttatttacttaatattctttcatttgagtagcaatgggccagaaaatcaagactgaaaccccggttggccatttactaactttgtgttgttaggcaagtttcttgccctctctgtgccccagtttcctgatctgtataaggaggacaatgacagtaactacttcagagggttgctgtgaggactgaatgagcgactgcaggtaaagcattaggacagtgcctagcacacggtacacactcaccaagtgttagctaccattgtcattacttttatttaaaagggaaactttatattcctaccttaaatggaaaaagcaataccacttaccacaaatagagttataaaaataaataaaatgaaaacggttattaaaccttagctaaggcctgctctcatttttttaagaagggaaacaaacagaaagatggtgaaggcatatgaggcttaaatgagggtgaccaaccttttgaatttgtccaggacctgtcccaattttagcactggaagtcctgcagcaattctcattcccggctgaccctggacagtcggtcaacctacctcaaatagaggctttctctccttcattcaaaggaataaaaagaacttaagaaggaataatgttcttacaatgtgatgttgtgtgtttaaggctgggtcagtatcccacatacgatcatcttgcagaacaagctcacaccttgggccacaccacacaaacccacctctgagagctgagtctccaaatgctataaacctatggaagagccatcatgtcacatgtgccactgagaaagtccccaaagaaaaatcacatttgtaaatgccaagaagaggaacagtgattaaattgttgcacggctaaaatgactctatgttataaaaccattgaaaaatcatgttttggagaatctttaatgatatggaaaaaggattatattagaatgctcagttttaaaaagcagactaaaaaatagcatatacactaagatcctagttttacaaaatatagagaaatgtaaaggaagaaacacaccataatataaacaatacttatcactgaggaatggtattctagagggttttttatttctttatatttatttctgaatttcttatttatatccacttctatattttccaagaaagtctagcaaagaacatgcattacttttttttctagaaaaaactgaatagaaattacaaattacaaataaaaaagtaataggaagaaagtaaccagagctgattaagcccagccttagcagactttttttacatgtcttctccgctaggaaaagttttcagtctggccgggtgcgatggctcacgcctataatcccagactttgggaggctgaggtgggctgatcacttgaggtcaggagttcgagaccagcctgggcaacatgacaaaactccatctttactaaaaatgtaaaaattagccaggcatggtggtactcacctgtaatcccagctacttgggaggctgaggcatgagaattgcttgaacccgggaggtggggttgcaccactgcactccagcctgggtgacagtgcgagaccctgtctaaaaaaaaaaaaaatgtttcctgtccgaccaactgtcctctgctttccacctcccttggagaaagcccttgcagagaaggcagggcttgtccagggtcatgggcgtgagttacctctgctaagactctgaatttgaaggcccatttgtgaggctgccctggactgtcgcctgaactcagagtctagcctccaaggtccacaggactaacatgatatcccctttccctctattcgtgattttcctgtgatttggactgtgacactcagtaactgccccaggacctaagttactaactagcggcagggtgacatctaatgcaggaagcgcccgctttggaccaaggtggcttgagctggagtccaccacctaccagctgtatgcctctctcctcatctctaacatgaggcttaaattaaataacagatctagcacagatcctggcacaaagtagaagctcaattaataccaattttctcccgtttccttttacattcactacctgagaactcagctctccatctccctcctctgactcagctccccaaggggcaggggcagggccagagtctgggggccccaagctctcttctccctatctacccaggcctctgcttctattcagtcagcaaacaatccctctgctgaccaataagccccagagagagcggctgaggggcagtccaggctctgtgaggtgacccaggagaggaggcagggtgagagaggtgggtaacttcaggcccccaccttgtgttctttagggtcaaactagatgaatctgatcatcaggcacatgtacaaaatcaacccagggccctgtgtaaccagaacccactttataagcattgtgtccatttattcacagaaacatgattgaacctgagcacttcgtgtgctcccggcattctgggtgctagacacacaacgggtgaggaacgggataaggtctccgcccttgcagggctcagtctgctcctccaggaggtgtggggtgcttctgtccacctctgttacaaagacttagaggagaaaggcagggctttttagaaagctgaggacccatcacgtatagttcagcccatcagtcaaggaacctagcttcctcacacagacccacagaactcctcatccccaaaccatgagcctcctcagcctcccagggattcagtttcaagtaggtttcacatggccctaacttcctcacccaagatactatttaaattccctgctttgtcacttggtggctgggtgagcttggacgagtcatttaacatcccctagccccactgtcctcacctggagcagtaaggtaaagatacatcccccatggcattctgtgagggggcatgtgaaatccctcgtggaaagcctcagatgcaccatgttgcaagggggccggtgattcccccgctgcactctgacatggggtcccaagcagacgggagctgaccatggaggtcaagagcagagcctccagagaccatggcctggggctgagcatcagctgtgcagtctctctgtgctaaagtgtcctcctctacaagaccagggtggaaagaatgacccctgctttgtagagctgtgggagtcatgagttactgtatgggaaggggaacagtgttcaatacatagtaagaaccatgtgtttgctgtttattttctttcagaaatatatttatggggataaccaatcatgtagtagcagctagcacatggttatccctccaagatgataaaggatacaggaatgcctcccttacctccaagcataaagataggtgcatccgctgtgaatataaacagccacccaccaaatatgcatgcacacacacacacatacacgcactatggaatcatggacagtacaaacatgataatgacaactgttttgtccattaggtcaaaaatcgcaagacacaattggaggcagcatcataccctggcattcacgtctgtgttgagaggcatgggcactggagttagagtcatacaaactcatacagggtttgagtcctagctccgctccatcttggtggaacgaccttaggcaagtcacttaacctgagttccctcccccatagaactgttggggtaggggagtgcagggggatgggcaactccacctgcctcactagcatgtcatcgtccctcggtgggggcaatacaatccttggcaggtcctgactcctttggacccccagcctcacagtcccaggaagcttcctccttttccctgcaaaagactctgctcagaccagatttacttccctgtgccaccccagtgagcagcctgaagagtgttcagcagctgccgagctctgggaggctggagtgctggccaggggtcccagaccccgggctgctgtttactcaaactgcagagcctctatagcctttacaactgtttcctgggcaggagggagcaagacagctgggcctctctctggcctctggcttccactggcttttcctttggaaaaagccagttcaaatggtgctcactctaggaatcgcttcaactcggagccctggaggtgagcagggccgggcacgggccgggcacatacaccccctctagggagcagggaagggcacaggccaggggaagctggagacaaaagaggagacagggacagagataaaaacagggactgtgacaagaacacaggatgggaagggcagagacagaaatagaggcaggcttaaggatctagacaggtcatgccagcccaggttcaaggcagaggggcgtagggggacagagagagagacacaggaagcacagaggggagaaagctctgcttagcagacttgccaaagctgaagaccccactgttgccacaaaggggcccacaggaaagctaggggttgcaatcgcctgtcaggacccacattttcaccctgagctgtgcacactttccaacggcaagcaaaaggagcacaatctagttaagttaggactggcaagattcacttctgatttaaaacttaagacagcaacaataaagatactcagctgaaatgccacccaacaaagccagctcccctggaaagttaaagtttagcacccccatcccagcaccctgtacctttaaggaagagaaggttccctccgcttcccagccgaagaggcaggttattctaggatataggggaggcttacctaaaactgagttattctcctttcctcctctggccagcctctcttcactctggggagcttttaccatttaaggtcaatgttacatctggctccggagctcagagccgagaagcctctggctgcagaacctcggccgcacgcctcctctgagaggggctgggacttagagccgagagctcctctgggagccccactccggcctggctcgggggataatggcagggaaagccgaccagctggcctcagggctcagggcaggctgggcctttggggcagtcgctcaccctgggcccctccgatgggtatccacacagcagatggcagtccccatggcaactcgtgccactggacactgtcctggccggacgggaacaaagggaccctgcagatctccccacccgcctggagcctccagcaagcatgtgagcctggagaagaccctgggccagcgcc

SEQ ID NO: 946 - DNA, 120468 bp, Homo sapiens
gaggtttggaaatgtgcttttattttcaaactcaggtatgtgacactctacagttcaatgctagcacacctgtgtgaggcttaacaacatgaggaactgatagccagtgatacacaaatccagcacttcctctccatttactctgtcaggctgtatatggggagcaacacatatggctttgtggcagccagaaagtgaaggtctttttaggaggtgacatcaacaatgacacaaacacatcactctgcaactgaaggcagggaaccagactcctagggctaagcagagatgtcagacttcagaggcatttgggggactcttcagatccacatcctcactgaaaatccagggcctgtttctctccagttcactaccgcttgggcagcagctcccactgcttcaggctggtctttgctttccagaaaagatggactcatgagcactttttcagcccctgtatatatggctattcttatgctcccttttggagatgtccttttcctcgacctcccttgcttacaaatggaatagggtgggagagggcctgtgcctggaagtactcttgcaggcttttctgtggggcagctggaggtgcaggagctctccataactgccttcctggcctttgactcatccagaaacaaaggtaggaaacttgtgaccaagtgaacaatggggccagctgagcctggccctgctttaagggaggcagagattgaacattccccacctggagttctgcttccacggccactctctagaactctatttgcatcctgtctttggctctgagggcctcatgtagctaaagctccttcagttgtatccagaccccctggaagaggccgggcaaatcatccacttctgcccccagagtccctctgccctgctctgtaactctttaccttaatggcacatccttgatcaaccctggcttgggcctcagtcattttctagctactgtaaaggatgcccccttcaataaacatgctattttaaagtggggcatgcttggggtggggggtctctctgaaggagtgactgcattgagcccagtccttgagcttggcaatggtgttgctagtctggtctcattcctgctctctcacagagtagactgaaaaacagaataagctgaggttaagaaagatgttgctttttgcattgtgatggtgctggtactgagaagcatgcagcatgtcagctgtccccaggctgctctccaccaccttaaatgtttgcttgttcttttgagcaacatttaatgacaccctcccaagcgtcagccaccatgctaggcacttacccaagagatgggtaagacatggttcttgtctttgaggaaaaatgctaggggagatggatacataaataggccatggtatactataggtaaaggtcaataataataatgtttaaaacgtgccagaaagcacagaggagtgtgtgacctattatgttgtgtctggtgaggagtatggaaggaaggtcatcaaagctggtatggaggggataatttttgcactcggtcgagaagagtgacctgaagaaaagagaagaacagctggaaaaaaaactagtgagtggaggtccagcactatgagagaaactgtttagttggggagccagagatggagtagctgatgggccacttgggggaatgagactgaaatgtgaggcttccagctaggagaccatcagaagagtcaaggagagcacagctctggagccagcctaccctggggttgagctccagccccatgatttactaccggggtgtccttgtcaagttacttgttctttttgtgcttcagtttccttatttgaaaatgggaagggtaatatccacttcgtatttttttttctttttcttcaggacttaaatgaattcatacctatgtaatactgagaacagtgcttggctcatagtaagtcgtatatgagttttagcaatgaaagcaaacaatatcaataacaaaacaaaaatgcaaaacaatgacaacaaaacccacatggaaatcaaacctctacaaaactgatgaaggcagtggctgtaaaagtggggagagaagtcaaaatggagaggggatgtgctccttcagtgttgtgctaaataactggggatgctctgaaacacccctaattatactggggttggaaaccccatttgaactgaagcactgaggtgcaagtttactcttgcatgtggtcacacacagagtaagagactgaagcagaaagcacatcttctctcctcattcacctgtgaggtgggttaactgttttcaaagagagaatagggaatagattgtgctgtacagcagctcagagttggcatttgaaatggagactagtaagtctgccattgaagccatgagttttctgtgtttttaaaacatcttcaatccatgtggacagctcattgaacaggtgcctggtgactgccccacactggtgaaaatctgtgggttggcttggcatgcatcttatttatccagaggtacacacccagagcacacttttgaagggttgttggctctgtgcacaggcatgttgtgtgtgtgtacacaacagtatgtgtgtatgtgtggacagatgcgtatataataattcatatcttcccatttcaagcactgagctaaattcagcctatacttttttttttttttctgagaagcctttcctacttctgtaaaaagaaactctcattccaaaggaaagaatgggaggctgaagttattgaaaatgagatgggaaatgggaagatagtcactttgcaactccaaattccaggtctgatgcttagggtgttagtcattaagcaaattcttcctgataaccaattacagagaggaaaaaagagagtaagttttttactgccccctacctcctcctcccccgtgccccgctccttacccccaaccaccagtgaaggtgttttagttctccccagccacctgagctaggggcaggagaccttcccttccaatagagttccttggtgaaggtgacttcttcatccactggatgctttcccagggcagttttgttgatcctccaagaacatcaagtcactgtgtatgaatagctcccacagaagtgccgagtgttaaaagaacccttcctcatgacctgatgggatgggcggcagtgtgtccacacttgggcctgacgttatacttggggaaagggtggtagtctgagtgtctcagagcagggcactggctaggtgtgaggtttcctactgctctgtaggctgctcatgctggagtcctgagctccaccaggagtccctctgggctgccgagcaagtggatcttccaaggggcccatcagcctgctctgcacaagagttataggaattgtagagccccagcacaacagtcaagaccagcatcactgcagccatcatccagatcacttgccagtgctgacacagtttgggatacatgacttgtaagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttatctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctcaagagttcacttcaaaccatccaagagcaggcagaagattagaagcctctagcaatgtctgggtggtttgttcatgatgttatctcaacctcattaatatttattctctaatttctccctcttcctcctcttcttccttcactctctccacacttctttctctatccctttcatctctctcttcctctccatttttgccccttttccctcttgattccttcccaactgtctttcattttgtcctctctctctctctgtggtgtggtaaaaagacaccgggcagatggcctgctttgacaagttcattctagagctctctgaagaagccctgagccccttcattaagccaggatttcctgatgtttttaacctctaacccaatttaaaaaataatatgaaaaatgagaatactgaggattcctgaaccaaggaggtggggaaagtgatagaagtgctttctgaagatcctgaggctcatacacacacagcaatgaccaagccattggctgagaagcggagagctcaaattttgaggtagcagaaaatgcatgactaacaaaggattgacagactcaataaatgccctccttagaaagggaccagatgctcagaatgcctgccttggatgctagggccacagagaacattgacaggtttccgttccatgcgggaaccccatcagatcatttcagtcacaattaaggaaagcacgaaagtgaacacattcgctgatttgaaaatcattgactattttcacaactgttgggaaggcagggtttagaagtagaaggttattttctctcagccctttgtagattctctagattctatttagacagagttggatgctaaaatggagcctttggggctgtatttccatcctccaaaacaaggtgccagagtggcttctccctactctaaccccactcttaagtgtggctctggaggaagagaccaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggtttacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggactgagaaatatcagcagagaaccctcaggagggagatgaggcctaaggagaacaggatctggttgcttggagtagggattgcactttaattgttaaacttggaggttctttcactggggagacagtgtgtgatttgttttcagtggagaagcatttctccagttctcctaacggctcttcccctgaacaatggggtcgaccagcatgggctgagacctctgactttagttgaattctccaccaactgggctctattgatagctcctgtgtgcctatccattttgcttctaatcttcacttcattacctatttgttgcatgcatgtggtttccagagttttccagcaatgaggcacagatacatacccagattagataatatttcagcagctgattagatattttgtctggagctgccctggaccccaagatatcccaggggtctaaaaatagattttggtgaaggttttccaaggtggctattactacattttaaaaaatcaaaattcaagacttgtggtttaactatactaatagagacaacatagctgaatatatgaaattgggctgtcctgaaaatccagaatgttggcatggttattatatctgtggggtagagtaacacctcatctatgggtgctagtttatcctatccctaagcgtgaacttctaggggataattcaggccaggtggggctgagacctcattcctataatacttcattgcatggagtgccctggaactaaattaggtcatttctacgattctgcatcctaaaggccaggcaggaaccacaagtgggacaagatacaggtctatattctctttatctacatgttatattctccttccccaacttaggggaaagtacctttgaaataggaagtattttaaaagaaaaccccaagtatttccaacctaaagtgaagaccaagcttgattggtcagcatggtaggcacctgctggagactcacctttgccactgagctgagtttgccctctattccgtgtgtcctccctgtccctgttcttgtaagaaactcactccagggcttcgagtcaactctctttgtcttgggcctcttcatggggatggctacccataatttcatctgggaaatgagctaaccatggctgggctgggagggactccattcagggcccttcgcccttccttagctcctggagctcttgattgccatcctcccttcccatgactgcccctgacctctcaagctcttgcaaacttctcattgctagctatcttggctctttgggatttcctctacctccttcccaacatgtgtgccctcttggtttcttgggctactcactggggccccagattcactgctgccctggactggcatttccagggattttgtgcatttaaattagatgaattgtaacccccatttcagcaacggcaaggactccaaacacaggcttcccacctgcttcttgggcccttttcctcttcctcagtttcttctacctcttcaggttcctcaggactctcactcttctgttcttcctcctcctccttcaggtcttgaagttctttggtcttctttagaccttcttggaatctggggggcaaaaaggaacagttgagtctggaaagggcagatgcagtgcatcctttcctgagttcctaggggaggggacttgagcagcacctccaataattatgtgcttcctatggttccacaaaacaggaaaaagctgggaagctccactgaatcctaaggcagctcacgccagtaccatttcccctcactcctcagtcatccttcctgtttatgtgaaagtgtgacaaaactgacagggaaaaaatgtggtgcagggtctcctgactgggttcttaacccacaaaacattccgtagggctaagattgtatttgttctccatgtgaccgtggagcttcagcctctcatctgtaaaagagagagggtgacactcatttcacagggcgttggaatgatttttgcaagtgccaggcacatggcttgatctagagaggtactcagtaaatgtttacgaaaccaatgaaggagttcatgcccataaattccaaggatagagcacagtggtgggtgagaaaggcacgctttcaaagagaaacccttgtggtttttctcccccagggtcaatattaccccaaacatactctgttcacttgtcctatgctgagtgtctaacactagcagtttggctgggcaaacccaccactgaagcccatgggttctgtgccagtgggaagctatgtcttcctcatgagctatggagacaggagacgcatagggcaccatacatggttggaggtgattctctaccttgaggcttggtacctgctcaggacttggtctctccagtgctgacaactggccatgggtgctattgaagctcaaatggaggaggaggcagttcgaagttgaagagactccatttataggaggaaggagtgaccaaagcagttctagggagcagagctgcagctgctcctgggcactgctggcagcaacatgactgctttgagcacgtgtcaggaagcctcaggcaccaccaagaggaacccatccaggacccctgatttccagactattctgagcggtggcattctggtggctctctgcctaaaaagagggcagtcttgttattgtctaaccacaccctctgaccctgcttcctcctgtccttcctgtggaacagtcttgctctttcctatgtagttccttcctgtggcaaggaggtcctgcggccactggttacttccctaaagcctctaagaaacaagaaagacccatgggaaggcatcttctgagaactgccaggtgcccttggggtggctgaggtctgactcaccccttgctgtaggcttcttcctccatcctggccttggtctcctgactaagctcctccaggcagctcagggtcagcgcaggagcagaggcttcacaatctgggtccccatttgtctttccactagtgagaagagggaagtacagggcatcatttcagaaaaaggtggaggcctaaaaacaaaaccatgtttttggcccgattcctgattaggagtgaggaaactcaggctttttcagtaactttcagattttttcccaatccttctaccctgagacaagattttataaaggtcctagtccatgaattttccccagcccattaaatacctcaccagctccccttctcctcatgctcccaaactggcgtttattcttattccaggagatgctgtaatgggtgatctacagcgctgagatgaggaaaatgggggcagaccagcacgtttaaggtcattccattcctgttgtctatctttcacctgaagacccccactcatcttttcaaatatccactcagcatgactaagccacaggcacattgtaatgtgctgggggcacattagaaaataaagaaatggtttttaccaacatggaacttagcagaaggaaaagccccaaaaaaggaaagaaaaaatatgtgattaattacaaataataacttttatgaaagaaattctgtacagtgacagaaaataacaaggagagaatgtgtttagagtgaatagttagaaaaggcctctctgaggtgctgaagttgaagcacaggcctgaaggatgagaagtcagatgtattaatagcagaggagagggttgggtgtggtggctcatgcttgtaatcccagcactttgggaggccaaggcgggcggatcacctgagatcaggagttcgagaccagcctggccaacatggtgaaaccccatctctactaaaaatacaaaaattagccaggtgtggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagatgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaaggcggaagagtaaacagtgccacacacttctgagtttgaagcgtgcagacaaggtgactattagatttgataatacagaggtcaacaggagcctctgtgtaatgttgggagccaagcacaggtttaaagtaaagaaggggaggttggaaaggggaagccacagacacagcaattcgagtaggaaggagagtagaggggtgtgttggagggagtgtgcagctgaagtaggtcaagggaggatgcacatttgaatgtaggtagaaatgatccagtagaggatgagagaaagggatgcccgaaggaactcagtctttgcaaaaggaaatagggacagaccttggaaaactagagaatctctccttgtttgtaacaaaggtaagatgatgatgaagttgttgggctggagatctggtgaaggaaagtgagagggctcctatgggaatgtagcttaggtattctctataaagtggaaggcaaggtcatctgctgagagtgagaggtagaggggtctaggaaggtctgtggagagaggaggggtgtaaaagagttatatgagaaagaaggaaaacagacatactagaacatcttggtaagatggctgggaggtgctgggagatcattgcaggtatgggatcacaagtttaaaggaagtatccagatggctatgctttccctagaaatcctgcagcccaccttcatgtcctgattcccaatgggagcaatgtcgtcatggaggagtcctccaacaaggcaacactgtgagcagagctttccagccaggactctgaaagatcacagctgccaccctccctgaactctcagacagggtttatgagtgagccttgtatcttctcctcattcttggcatcagtttcccatctcttagttttcctcagaccttttaaaatttacatttagtcaggctggaaaccacaacccattgtgaacaagaaagataacgctctaaaaataccagctgttcataacatttctccttttgcaaattacattatccactcccttccatgtgaccttggcctaatgtgcagtttcctatttatccaaacgactggagcaagaggagaaaaacatagctacagccaagggcagggaaagtaattctttcatgaaatatatatatatatatatatatatatatatatatatatgaaatgagatattggtatcagacttttgatttatatacaactgtcagccttagaggttccttaatgttaagcatgcgtgaaggaggacagtgtagtataaaggaaaagaactcgcctgaggcaaacttggattcaaataccagctccaaaacatgcaaattatttaatcttcctgaacttcagattcctcaactgtacaatggggatagtaatacatacctgatggtggaggtgtaagaattaatgaagaaatgtcaataaactttctggaatatggcactcaacaaattatatctgctattattattgttatatagtaaatgtattggtacattttgggagcaatctgagctacctccaaatatgactcataaaaaatccaggcaattatttatatcatcaagggagagcttgttatatattactgagacacttcagagtcagaggaaccctaaatgtgaactaatttaaggtatggtaaattaacattacattttcataaaatggctttaggaactttctcaggtgcatgtctattgtgtgtcatcacacattatgcaccttagaattttgcagataagtgactgtaaacaaagctctcattgtccttgggtcactgatctctagagaggaaaacttttccctagcagggccaggaagcccatttcatcgactcttttacatgcagatcttctgttcatttcagctcccctatagggctctcatatacattctctcacttgatctttccaatgataagaagagctaaacattaacttatatgtatcaggctgtggtctaacatctcatttaaggctcacaaatgacccaagaaggtattagtgttctctgtttgacagatgaggaaaccaaggctcaaaaagtaggctgaggcatgagaatcgcatttcaagtgatttcatatctgtcaaacagagaacagtaataccttcttgggtcatttgtgagccttaaatgagatgttagaacagagcctgataagtaagttaacttttagctcttcttatcattggaaagatcaagtgagagaatgtgtatgatctcgggaccagcccaagatcatacaaccagtgtgtggtagagctcaaattttaccctgtgcagtctgatatgtgcccattcttctgactgcactatctgccacctaggtggggtattatcccatttcacagataagaaacccaagctcaggttgattaagtgacttgcctaaattcacgttattggtgctgggactctcaccttggtcttctacctgtgtgtcaagatggactttccagccctccatgaacccccgcttttctttcaatagaagccttccatgaacccccacctttctttcaatagaagccctccatgaacccccacctttctttcaatagaagccctccatgaatccccctgcctttctttcaacagaagtctcttcctttcactctgctgagtgaagcccttcctgccctcaggctggaccatggcttccatgctgcccctcttttcaaggctgcttgtctacagtgtaagtggctgggagggcctttgtttactgtgtgtgtgtgtggagggtgggtaggggggagtggaggggttgtgggtagggtggcaagtgggggaaacacaacatgtaaaatgtttgctgttctctcctgacctctaaactgagcttgtagtttcctaaatatcttctctaactatctggaagtttctctctaagcatctttaagactaagctcaaatgccttctcctctgtgaaacctttgctggtgttctcccctcccccacaccctctggttaaagttgatctctcctttttttttttttttccttgagacagggtcccgctctgtcactcaggctggagtgcagtggcatgatctgggcacactgcaacctccacctcccaggttcaagcgattctcctgcctcagcctcccaagtagctgagattacaggcgtgcaccatcacgcctggctaatatttgcatttttagtagaaatggggtttcaccatgttggccaggctggtctcgaactcctggcctcaagtgatccacctgcctcggcctcccaaagtgctggggttacaggcatgagccaccgcacctggccctctctctccctttatgctgccaccgcacctctgtgacagcatgactcacagggaggcattgatgtatgttttagatacctgcatatgactgtcatcacaggaagaaggactgtgtttgggtcagaatagtgcctggcatacagtaggtgcctttaagtgcctgtcaagttgcatcggtttcactatgacttatccagtccctactaggaatgttgtaaaaggcacaagtcctctctgtaaatggttatttcctgagaacccagtgtttgggttggactaaacgaatctgtaatcatggctataaactggagctgagcacagcctgtgcccaccctagggatttctggcccgaaggctcatggatcttggcatctgtcccctgcctgaaatcctatgtgctttctttctgggatgattcatgaaaatgaggctcattattctcacacgtgcaccaggtcaaaaatgtttgtcattgtgctcagctctcagtaatgtgaagaactatttagtcaaaatatatttttggacaggcaggtatattagattcaacttttcccacatggtaaacaatatttgaaagtggctactatcctttgtgatcggcatatcttcttgggctcagcaatatttccaagtcacccccactgccatggttccctctgacaagcccagcccagggaacccaagcttccttactccgtgttactcagttctagatacctggggtccgccacaagtttattggggtgggtggcgggagggaggaattcactccaagataccatcagcaaaggggagttgcttactgtacaaatttagtgtcctgtgaaatctttaaggaatttaccctgggtgcttcaagagtatagaaacatggttatttttagagattcagagttaaaattgctctgtgatacattaacataataacccctttttgacactaaccctgtgcatcatctacatcctggttttgctgatcgctctgtgaacggttccacacacaccctgtctctcaccccgactctgttctccactccatgcccaaccggtcaccatgctctttcaaaaatagctcttaaattcatcctcttctctatggtcacactgaacttcgttttgttcttccagttgggcggtctattaaaagggtaagggcatgtgctctgctatctaccagctgtgtaacctcaggcaagtgacgatttctctgagcttcagtttcctcatctataaaacagagatattaatagtacacctacctcatggaattactgtgaggattaactgagattattaatacaaagcaattagcaaagcacttggcatacagcgaggtgcagcaaatagttaacagtaattaccattgtcatcagtgcagtagttaacagtaattaccattgtcatcagtgcagtaaatagttaacagtaattaccattgtcatcagtgctgtaaatagtcaacagtaattaccattgtcatcgttatcattatcatcattccttgaatactccatactttgtcacatggacaaagcctggaatgttgttaacctcctgttcacctagttgattatgtaccctttagatttttactttaaaagtaagttcctagagggaaacttttttttttttgttttttgagacagggtctggttctgtcgctcaggctccaggctgcagtgcagtggtgcaatctcagctcactgaaacttctcccggctggggtcaagccatcctcccacctcagcctcctgagtagctgggactacaggtggacgccaccacgcctggctaatttttatattttttgtagagatggggctttcgttatattgcccaggctggtcttcaactcttgagctcaagtcatccacttgccttggcctcccaaagtgctggggttacaggcgtgagccactgcccagccaaggggaatcattttctaagctctctcttccccccacttccccagttcccccaaccttacaccaaaatcaggttaggtgctcattttctgtgcatcattcccttagcaacctacacttccttacgatcccacccatcatgttgtattataataggctgcttcccatctgtctttcccgctagactgcaagctccttgagtacattctatgtgcctggcccttggtgattaattgctgaaggaatgaaagaacaaaagactacaattacatagccatttctacttgtggaactgctcttgagctttgttttctcttcatcttcaggactaactttaaatatcactctccacccatatgtttaagtctacaggtttctaggcccttggtgagtgaagagcagttcattacgaaatgacctccaagaacaaggctcagcattctctgaaatctcatgaagcagtgtaaccagctctcaagtatcttcctgtgaactagccacagggtatttgatcttatcctttgcttagccagtgcccttcctgctttgtcactgtatgcttaggaaaggtgaaatcattttaacacaaagctgaatacaacagtctccaaagcaatgtatattaaactataacacattatttctctttcacgatatggatagggcagttagaattgactgtatttgtgtataggacagaagatacgaattcacttttactcatatattgtctcattgttagtctgttgggaatcaagtaaattttccactttatatttatttatttatttatttgtatttttagtagagacagggtttcaccatcttggccaggcggtcttgaactcctgacctcatgaaccacccgcctcagcctcccaaactgctgggatcacaggtgtgagccaccgtgcctggccatgtttccagttttaaatggaaatcacttaacatctttgagaaatccagaaggggaagctgttgttcatcctgaacccctcttcctctaaagatgccctcacctctttgcaaccattcttacatgggtatattcccaactggcgagtcagccccagtgtgcttgacttgccttaatccccactctgtccatatctctccaggttctataaagcactggaaaggtgatgccactattgatcgtcacccattgacactcctaatttggggctgctgcttattgtctccaattttgtacctcagtttcccttaccaaggataattcatgttttcatgatccccactgccttggacagaagtgctcaactggcctggcataagttctacagagttcaggccctctctgtcatgattaagagtctgttgaagagatcttctgccttgagtggctctgcaggcctagagttgggaaaggggctagagttgagggttctctgaagtagggatctgtgcacccaaagggaaggttggcagggagaattttagtgggtttctcagtcagagcatgaggtgaccatttctggagagattcagagaccctggatgaggtactatgactctagggacttggtaagtttctgtaaactcggttacttccatgtggtggtggttgtgttgcctcttgacaatttccctgtagtgatcaagaaaagacagagagagagaccccaagagaccctctataacacgaaggacctgtgagcttatgggggtgaggtggcaaagagacgaaatgctgggcaaacttcaagactaacaaatcactgggtgataagctggtggctatacagaatgacagatgtaggaggcaggctgagtctggagatgggagcttgtctgtactgaaaagggtcccaacatacaggttccctgccagatagcaaaacttttctaacagcaaagaaaaacaaaggactaaagctgtcttgaggcaaggaagaaggaagaataaggtatatgttttaccaagtgagaaaagacacaaggggaaaattctgagaggcagcaggtgtgatccagatgtttttcagcaagcaaatgaaagaatttgaaaagtaagctataaaatcctctgagtgcatagaaacagcctgccttactctggctgaggatgaaaagatctgcaaattgcatagatgcctagaaaatcacagaaactgctggctgctaatccaatatgcattttccttcctacttcctaacagcaacatgattctgttcaggaatttactcttcttcatggagtcattttgctttatgggaagctgaccctctcaccaaccccagggaatagtttaatcccataatgacaatccctttcccaaagtgattcttttagaaagggacttccttccagatttgtcaatgagataatagagaagactggtgaaaggcttctgggtttattcctaagaaaggaacatggcaagaaacagtccctttcttcctctaggtattgtcctgtctggaggggatcccaggaactaccagccatttgccacaatcctgatgatgaagttaacatacaatgtggccagaggcaaggaagttgtagactcgctgagctagagccctgctgtgccataccaggagcagctctacctctggacttaattaagtcccattgagttggggctttattttgtctgtagcccaaggaatcccaattggcagagaaggctccagccttctctgggctctctaagattgggtacacttggcctcactcagggcatcttcctggttcaagaattttgcaaacaggttctgaaatctttgtgggtttcagactcccattcatttcccttaaaacttaatttgctttccactgcattttggggataaaaatgggaggaaggaaagtaaaatggggaaaatttcctgagagatccctgaagccaagaggaaaatcgacaaacttacttttccaaaagtgcaggcagtgctgaagtgacaggtaggctgcctttcccattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagaggagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttttaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaaaggcctgggatacagaaaatattttgttatatccaaacgtctttgtctaaaagaaatggaaatgtatttttcctgattattaccaatacattcttattatagaaatataaaaaggcatcaggaagaaaataaaaatgaactattttaccattgcctagagataaccattattagctgtttcacatatcttctaccagaaatttctatgtctacacacagaaacacactcttttaaaaagtacaaaacagaattatactgtttatacactaggttttgtatattctattttacttgcttttgattcataataaattatggataattctacagaaaccccttataggaatatccatttgcttaaccaatctcttattagtgaacatggagttgtttcccacttttcattattatgaacaatgctacaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcacttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacacaggtaagtttcaggctaggcaccagcaggaaacagaaactaggctatcgtatccatgggccagaactggccctcaagggatagcccaagggtctgggtgttggggacactgagtttggcacttcatcctttgagatggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagagcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgtcacgtaggctggagtgcagtggcacgatcttggttcactgcaacctccggctcctgggttcatgtgattctcgtgcctcagcctcccaagtagctgggattacagatgtgtgccaccacacctggttaatttttttatttttagtagaaacagggtttcgccatgttggccaggctggtctccaactcctgagcttaaagtatctacccgcctcggccgcccaaggtgctagaattacaggcatgaaccaccacacctggcctgtttttttcataatctaatctgagattctctattaaccaatagatttatactagttatagttcttgtgattaatatatttgtatttatttctaccatgtaattttatattttctatttattttgttttattcattgactttttctacccctcctcccacctgacacttttgtttggaaattatacattctatttttaacctttagcatgtcctcttaacttttgaacatactgactttaaatttaaaattaaacaagctctctattcttttcttgaataaatcttaaaataataaccctccctcttaattatattgctttccaggatttttatttcaccttgtgtttgtattcttaaattattcattatgtttgttgatttctacagagagtgcttatttagatttacccacgtttacaaatgtctttgttgactattctttcttgtatcctacttgtttcttttgagctcaattttttttaacttttattttaggttcagggtacatgtgcaggtgcattacataaacttgtcatgaagatttgttgtacagattatttcgtcacccaggtattaagcctagtagacagcattgattttttctgctcctctccctcctcctactttccaccctcaagtaggccttggtacctgttgttcccttgtttatggccatatgtactcaatgtctagctcccacttcttagtgagaacatgcagtatttggttttctcttcctgtgttagtttgctaaggataaggacctccagccccacgcatgttcctgcaaaagaggtgatctcattcttttttatggctgcatagtattccatggtgtatatgtaccacatttttctttatccaatatgtcattgatgagcatttaggttgattccatgtctttgctattgtgaaaagtgctgcaatgaacatttgtgagcatgtgtttgagttcaatttcaatcttccttaggtacatcctctagttgttctttcagcgagggtctatgagaggtaaactttctcaattgtctccaaatagtctttaccaagccctcaatcttgcatggtatcttagccatctgtgttatctctagattgacagttattttctcttagttcttttaagaaattattccattggcttcttctattattgccattgagaattgtcattcctttgtaagtaatcttctctttgatgacttttaagatcttccctttgtctttactgttctgcagtttctctttggtgtgtttttatttttcctgcttggaattcacgtattttctgaatccaatgattgatgactttccttagttctagaaaatccttagccattctttcttggcatattttctctccttggttttccccttaaggatggcctaataaatgtatttgggactttctcattctgcattctatatcccatatctcaatgcttctttcataattttaatcaatttatttctctgaactatacattgggtaacttcctcaaacctatcttcaagttaactaatttttcttcaactgtgcccaatttgatttaaatgttataatcaatcaggataagctaggttatactagtttaatagcatagtaataataagcaactccaaagtattagtggctgataacaaggaagatgtgatttgcttatgctacatgctcatttacttccaagtctgcagcaagcttggttctctgtttcctcactctggactcagcctaatactggccttctactattctggagcaatgatggttatcatgttaggaggaagaaacagggcaaactgcattctagttcttagaggcctaggttcagatgtgacatgtccttctactcatatttcattcaccaaagcaaatcccatggccttgccttgtgacttcaaggggatgggtaaatgtgcccagaagaaggagatctggaataatgaagaatagcctcaaatatagtaactaccacatctaaactcttgagtttttgatttctgtgactttattcctcattttgaggagttctattttattcttctttgataactgtattcttttactctgtttttgatccattattttatgtctccaataatttttgtttaagttagagacggtctcactctgtcatccagaatgaagtgcagtggcatgatcacagctcactgaagccttgacttcctgggctcaagcgatcctcccaccttagcctcctgataagctagaactacaggtgcccaccaccacatctgactaattgctttttatttttattttttgtggagatagggtctcactttgttgcccaggctggtctcactttgttgcccaggctggtctcaacctcctggcctcaagcgatcctttcaccttggcctcccaaagtgttaggattacagacgtgagccactgtacccagctacctgtaacaattttaagcttatcttaaaaaaattgtcagatcattttattttccgaggttcttaggatataatcctattgttttgtgtaactgatgacttttgttcatgatgaattgttttcttgtgtattttataattttaagttgtgaagtcatcttcagtgaggctttattagaggaatcctgtgtgtccagatgcagggtctgtctctccagagtacttttctgcttatttctaacatatcttagaagcaccatcttgctgttcttttcaaatcctctgcatattgcatcatcactgctgtcactttgtgagcacgtactttccctatgaggaaggagaaagtgttttttcctactacagtccagggtgaaacaaatttccttgtttctctgctggttggtgattattatttttccttatccaaattccatctgaggatatagtccttggacgcccttaactttctgtgggaatctgtgtcaactctctaccataggtgttccaggccttgtctcagaccacaggcaagtgcaaaagctcagctcccagataaccaaggctgacacttgtccctaaggaagctgcagggtcagcttggtttcagttctcttttcttttcttgtatctgggtatttcaatttattttcttgtggattcagctatttagacaaaggtttgctttattttgtccagcagcaatttctaagtgcttgtggtcaaaagattttcaagttttccagtcagccaaaatagcagaaccagaaaatattctttacatgtgaagagttcatataaattagtaaactaccaagcttacaagtggcaaaggtcataaatacagaatttttaaaagcagaaatacaaatgttccataaacatttggaaaggccaagaaatacaattaaaacaataagacaagacacaattgtggcctatcaaagtcatggatatttacaaaaagaaagaacaagaattgtgtcaatggcacggtgaattgagtattgtaacccattcagtgaaaacataaatgggttatttgaaaataatttgctttaagagccttaaaaaatttatttcccctgagctagtattcatacttctagaaatctacactaaggaaataatctaaaatgcagataattggtaaatttcatattcagaaagaaacatgttatttttaaaaaatgtatatcaccttccttgaaatcagggatattttatttactgcagtcttcaaaaccccaggcatagacaaagattgcagaggttgtataaaggcttaagacacaaacactattagggaacagtcatagagtatcttatggaaacacctgctgagtggttacggccactctgcctagcccaagctgaggtatagcttggaagaacaactggagtggaaacaaatatcagaaaaacacgtacagctatcgttgacctttcctacggtaagcgttttctcatcctcctagagtgaatgtgggactctgtggtgtattctcctcggaagtctgctttcttctgtcatagcactggctacactgccttgacttcccaaaggttgggagctcctttgggtctgtgactgtgtgccctttacctctatattccagtattatatagggcaaaccaaaggtactcaataaatgtctgtagaatgaacgaatgagactcatgggtaactgctcatcctataaatcttaggtaaggtggtttgcaggaggccttgtgcagcaataaatgcaggagtccacgcattaggattcctttggcggcaacttcctcagcttccaacactgacggaaaatggttagaggcctaggtgcatgtgggtcaggagccttgctgacagatccaaagctgacagtctggagcatgtgtgcatgctgcctttggactctgggacatgtcactgatattctccaggaaacttgtgaaacctcctgtttataaaggtttctccatctgttatactttctgtactttcccttctgcagctcttggtaacacggatgtttgcattccacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaccaatgactccccgttgcctagaggctcaaattgctagcatggcctggcgtgtggccctggtcaaccaagtctcacttccacaccctgacactgccactatgacaaactgtttgtttcatcttgttttcacccccaacctccacacctttgtccatgctggtttctccacttgggatgtgtcttcctctattgactggagaactcctatttttactttaaaacaccaacaagataccatccctctttgaaggcttctttgtctcccttcaagcagaatcaggtgggccctcccccgtgctcctatagcaattcgtatagaacttctaaacaagagtatttctttgaaacttctgtcttacccatgagtctgctgtttttctccgtaacatctccttcagccagactctcactccaccctaactgcccaggtttcacccctcacctggactgttgcaagaacatcttcatggggttttctatccctgctttgtcccagtaatgtaactgccacaccacagttaaagggaatcttcttaaactacatatatgatcaagtcattttcttgattaaaatcattggctggatccctaatgctttccagaataaagcccaaattccttagcatgtgctgcctaaaaggggatcccaaagcacacggactgacagggtctagggtcactctcagaccctgtaagtccaagagctcttgtagcccatgggctttgtatccatggtcagccactgtgatttattgctttgggagttaggaagtcactttggaaaggctcatgtttcctggttccagactgccctgccaggcccactgaagcagctgctgggaggcccctgtgggcagcactagacaggagtgctgctcaactggaaataagtcctggggctgttctgacagctctaatcctagccaagagctcttggaagtccaccttgtagggccaagatggggcaggagcctaggtccttaccagaggggccacagctgcggcttgaattctgatttgcaagctttttaaactccatgagctccgcatggtccttctcatacgtcctctttagattctccacatactgcatcatcacttccgttgctttcgacatgcgcttttcctgcggggaaggagcgcatgagtgcatgaggccattggaggaaaggctccgttggcacttatttgctctgacctagggtctgggctaggagaatcaaaaggatacagggacaagactctgccctctgaagagtttgctgtctgccatgtgagctgagaggtggactcagcacctgcgcttagggagaatgagaaaagcacagccaccacactgcaggagatgacaggcagaggagagttgtttctgcttgcagagaacgggtcaggggaggcttcatggagagggaatgcagtggatgtaggatgtgagcagcatctgggcccatagacaagggcaggagggacacagcgttcaggccagggaactccaagaggagtctagaggcagggaagcacagggcttatatgtagatgaggttttatcctctgaataagagtcctctggagagtgaagaaaggcacgacgacaaattatgctgggacaatcgacataataaaccagggctgtccagaaagcccagacactgcaggtcctcctacctatgtagggatcagcaagcagttgggtctatttgtaagtctgggttgtgaaggacctcgaatgctagacaaaggaatttgaacttattctgaaggaaaagggaagccattgaatatctcccttaaagtaagagagtaatataatcaggtcataggtagagatgggactcaagggagtgagactggtggcagtgagggcagcaggtaaaaacaggatgaagcctgacctggcccagtggagccagagaggaaggcaaagactgagacatagcagccaagacgagggagccatttggagaagggagcagatggcgtgagtgacaggtgggctgaggcacaagtttgggaagcctgcacacaatgagaacaatttctctctgctcataccccagttagatccctcagaggatctagctcaggccctgcctggccacagagggacacacccagtggcttcgcaggaacaggtcccacagtcatgcgtggctgagaccagctacttccctagagtcctcccgtgttgctgctcccagctggagtgacttcctgggcaccactgctgagtcagatgtccttgtcctgaaggacacagggtgggatggcccagcgacaggtctttcttttatttaataggaactgctcagggctgcaccaccccaggaacctcctctcatgtaaccagagcagcaggacatagattcatgtcatagcaacataataacaacatccaaatgctttacaagtacggcagcaaccctctatggcagatactgtgaccatcctcattttatacttgaaaagactgaagcagagaaacctcagtaaggggcccaaggtcacacagcgaatgaaggttggagccaggattagaactcgggcaatgtgctcctgctacaacatggggggccggggcggggctctgtatgcttcaggacttcaaagtggccaagagagagccagacctgggcctgtgccccgctccgccactaacgcttttactttctgagactctgcatcttcatctgggagacaggatatttatagggttgctgggtggatttaatgagacaaagcaggttttcctaaagtatgttttgtcaaatactagctccatgggagttgaacaggtattttttgagaaaaataaaatggagagctgtggggggaattcttcagttaaatacgtttgggaactatgtaggtaaagtgaaccagccttctccaccacaggagttaccaaagccttgattaggccaatgtgttagaaatttccaagaaagaaagatagtatgcagtagtccccaaacttgtgcgtccacagaaacctttttccacaaagcaccttgagggttcagtgatctgccaaaaatactctgaataatactgcaatgatgtgcataggatgcctggcccagaggaagccacctctaagtggtatctgtagttgccgctgcttgggtgattgctctactttacgtaggtggaacagagttggcaagaccgggggctggagagactcacctggcggacggcgcctaccacctcagctcggctggagaggcgggcagccaggcggtgcaggacagcgatgtcctccagcaacttctggtaggtttcccggtgctcacagtggtgccagagtgaagctgaggactgaacaggagtaggagcatcacctggggtcctcaaataatgttatggactaaatcagcagtccccaaccttttcggcctcagggactggtttggaagacaatttttccacaaacctggtgggggcgatggtttggggatgaaactcttccacctctgatcattagattcttataaggagggtacaacctagatccttcgcatgcacagtttacaatagggttcgtgaccctatgggaatcgaatgctgctgctgatctgacaggcggcggagctcaggaggtcatgctctcaggcagctcacctcctactgtgcagcctggttcctaacaggccatggtttggtaccggtttgcggcctggcccaggggatgcggaccactgggctaaatgtctgtgccccccacaaagtcatctgctgacttttggggggacatatcctaactcctcaatgtgatagtgaagtggggcctgggcgaggtgattaggtgaggagagtggagccccacgaatggaattagtgctcttataaaagggaccccagagagttctgttctctttccaccatgtaagatataatggaaaggtggtagtctgcaagccagagatggccctcaccagaacccgaccatgctggtgccctgatcttggccttccagcctccagaactatgagaaataaatgtttgccatttaagccacccagtctaaggccctttgttacagcaattcaaactgactaagacacacaccaagcctagactcagctctcatgaaagcagctctgggccccatccaggctgagagaagtggcctctgcagggcctgggccacagtttcttctggtgcttggagaagcccaatgtgaacacgctatccctggcgcctgaaagtaggagtcacacccaggccaccctgcccccttctgagaagctcccaaggctttggaggacctgtccacagccctgagggaaccaggcctttgggatctctgcctcagttccccccaactctctgaggaacactgtcagagtcttggctcaatttttcacttcaggagactatacttggtacctgagagaagcatgacaccctgtatggcccttggggacagtctctgctccagggattcctcacatcaggctccacaattaccgtaatggaagctttgaagttttccagttctttctcagtgttctcctctgtcaggttgcgttccctttcagcctggttaattctagattccagagtgtagctgtcatttctaaaggccaaggacagttgcacaaacacgttctgttgggaacaagggtgtgagagaggtgctgggaggagttactgcagaggacaaggctgcagctgtgctccttgcacgagcgttttgcaacggcccctggaacagccgccaaagcaccaaagcagccatgtgcaagggaaacgctcacttcacaggaaaccacaaaaaagatggtaaagcagggaccaaggtccacgctaggcccttcccagaaccggaggtccaaatgtattctaccaaaaaataagaagagaataacactttgctttttcctgaattttaagaaaataacatcctgtatctgggtttagataaactcaggccagtacagctaattgtgtaagcatctggatttatgctgggatttattgcatgaggggttttggagattttgcaggaaaatactgtattgaaagaaactccatgtgagatttaagcattgttgacgtaaagcaaacttcaatcagcatctagcccgagtattccaaatcctgtattgatagaagctttaagtagctgccaggagattaaataaggccaggtatgattctgttcggttaagctttctggaataaataaatgtttcatgctaaaattgcagcctgcatgaacagactttgaaaagataatattggtcatacatggaattcccagaacagtaggaaactactagggagaagaaatagacagatggacctcactcaggaaggaagcaatggtcttcaattttacagccatcatctgccctgagtggtagcagatttataccctgcagggttagtaaccacaggggcttctgaagttcatgtaacatggcccatggaaggcagtcatctccagaagaattgaaggtacagaattgacccaatgatgatgatgaaggcaatattgaaaactactccttattgagcatctactatatgccagcactgcttttcattctacaaattcatgtaatctcacaataaccctctggggtgggaactgttatacctgtttatgggtaaagaggccaagaccagaacggtcattaacttgttcaaggtgacacggagtaacggagccaggatttaacctcagactgtctgatttgaaagcctgttttatttccaccatgccgagagctgtgtccatatacatctgcggtcagcatttggacattaaacaaaccgcccatggcccatcttcacaaatgtcagtgggtaggcttagagctcatagcccagtgatagaaattttctgccttacccggccttggtcaagtctatgaataatgctcaatgcttaattttctataccttgattatccccttaacagcagtgtgacacaatgagttctgaattcagtgagaacacttggatctaggtcttggttttgccaactacagtatctagaaacttggtgtggttatttactcactcagttttctcctttgtgctgattcctgctccacctgcttttcagagctgctggttaggatcagctgaaaggatggctatgcgtgtgttatagactgcaagtgcaatgcctgtgtgcaagttatagatactacctgtggtagatacttcatactgtctgtcttcctctgcttatctggtccacatcagcagttctcattgtctcacctctgataagttctctttgtccgctacagaatgaaatgcagattcccctcagctcactcacaaccccgctgggacaaggaggccccagtgaggaaaccggaaggctggattgctgacagcacagcttcccggctccgctgagctggcattcttgtagctgaaaccctgaggaggccagccccctttcccactaaactaaagcttagaacttgaaatctgaccatttttcagtaattttgaaataaatttgattcaattctgcagcctcccagctggttttgtgtatctaagtcgtacatttaaagaatataaacaatccttacaggaatgtaaaatttccaactaccttctcccttttgcccaaatttgtcaaaatcttccatgaacggacgtgggaatggggatctcatggttcaagagggctggtcatgaatgttcacattaccccacagtcactctttctcatttttgtctaaaaatgtcagagctagagtctggaggaagaaatgttttgaataagcccagtcaagcacgggcactaaatttcataacacacttgagtcacttacctcaacttccttttcagtgagtggaggggcactgtgaaaaagaaaacacacaattgaactgtgtgcaacctagtcaatagacccaaaggtgactctgaatgaccagcagaccatgtgtttccaggggtggagtaagctgtgttggtgagaaggaaaagatgcaatgtccccttgcctgtgctctgtcacctgtgagatactgactcttacggcaccatgactatctctgtgactttggacaagttatttaatctctctaagccccagcgtgctcatctgcaaaatgggaatcatatcacctaccttgcagaggtattataagcactatatgtactcatgtatgtatgtgtatgtgtttgtatgcataaatatatggcatccacactcagtgggctctcgggaaatgtgaccttgaactcatagccttgctgtgagaaataagaaaatgcatgtgataaggactttataactcatacacatctaagttgccattataattgttctggggatatccacccaggtctgcaaagcctcaccctcctctgtctctgagggctgtgacaaaggtgcatgcgggccagagaataaatggtaggagagagtgaccagggttcttctccacagcaagaacttctgatggctagaatcacagagtggcaagaaagccccagccgacacagaggcatccttttgagcagctcctcgtctgtggcgttcccacagccagggctctccagctataggcagtccctgcatctgcatgtccactcgatgctgctgtggctgctgctcttgctggtaactaaagctggccccatctgaagtccacacaatgtaaataatgcacaggccctttcctgtgctggggcggggaggcctgggaggggtcctaccagcgtcacagaacttggcaacagagcatgccatcaataagcttctcaggaaacacagcttcctctcttgaacgggtgtgaagggaccccaagagcaaaggtaggggtcagccatctctgcagggggctggttctcacccctagggaatgatatgagtgccttcctgtcaggatgagaagaccccatggccatgaagtcagcggagtccagaacacgggacaaacagctgcagggatgtttgacacttacagtccttgtcacaaccccacccatcaggcccttgccttaactgtcatctacagcatacacatatgatttaaatgatttggcaaaacttgccaagtttgtttctgactcctgggtttgttgggatattatgtgaaatgcacatattttcataaattataaaccaaacatttttctatttcaatgactcacattctgcttttttgctgtagaacacacccaccttatttttattttatttatttatttttggggacagggtctcgctctgctgcccaggctggagtgcagtggcaggatcactgcagaggtggcttactacagccttgaactcctgggttcaagcaatcctcctgcctcagccaccagagtagctgggactatgggtgcatgccactatacctggctaattttttatttttattttttgtagaaacagagtttcactctgttgtccaggctggtcttaaactcttggcctcaagtgatcctcttgccttgagcctacaaagtgctaggattacaggtgtatgagccaccacacccagttagaacatacccaccttaaaaaaaaagtgggggtctggggggaaactctgaggactcagagaagtatgatttaggcagagaagccacatggtatgtctggtgtctgatgcagataactgtgccttacaaatgggcataggtacccgggggcagagctgtgagcctctaaaaggacacagcatcttttttaagtgactatttgtatatcttctctgaagaaatgtctatttaaatcctttccccattttgaaaaattggttatttatctttttattgagtgtaagccttctttatatgctctagaaacaagttccttttcagataagtgatttgcaaatatttcattctgtgggttgcctttcactttcttgacactgtttgcagcacagaagtttttattttgaggaagtactatttatttttaaaatcttgtctcttgtgtttttggtgccatatctaaaaaacccaaagacatgaagatttacttatattttttctttgaagagtcttatagtgttctctctgacatttaggtctatgatccattatgagttaatttgtgtgttttgtgtgaggtaggggtccaacttcactcttttgtatgtggctatccagttgtcccagcaccgtttgttaaaattacaatttttttcctctgtaaatcttaccaaaacccttgcatgagtggctttttgtcatttgttatttgcacatctcaaattattactttatcacagaggcctttccttgacctcctacccaatgccccactctcatgtcattctctagatgtgccctattttatggtctttctaccaactttactctttcaaatcattcatttggttacttaaatgttatttgtgctttgggaggccgaggtagaaggatcacttgaggccaggagttcaagattatcttgggcaacatagcaagaccctatctctacaaaaaaatatttgaaaacttaactagtcatgggtaaatggtgtatctgggattgaaacccatgtctcctggctcaaagcccattctctgctgccatgagcttctggtgacccttatgccttcatgaactgtgctcacctaagaaccccacctggcctttgagttgaaaacacccagcctggcctttcattattctttttgtttcgaatgcattatccctatctagacaattggactttggcccttctgggttcaagaattaagactggtgttcctctgtgtcccacctagaatccaacacaggggccactcggtacagggccttctgtaacccacatcctgattttaccttccagggagactcctgtggacccgcagtttgcgcagcagcacatcagaaatattaggcatgacatctaagccactctttgactcttcttcctcaatagctggggagagttcagaaggaagccctgaaaaaaaagtgcttacttataaaatgtctctttgaaatcacagtagtactgttggcagctagcttcaggagctttgacatttataagtatctagttctatgttaagggctttttaattgttatcttacattattctcacaatgagctagaacttagtcatcccatttcacatgtagataagccaaggctcagcaaggttaagtcacttgctcaagattacagaactagcaaatgacatggccagacctcaaggtctacctgcttcaaatgttatgttcttccctttgcttcccacagtattaagctggcaattggaagctggttggctctttggctataatgtttgggaaaaaaacctgctccttggcaggcttctcaggagacctgttgttcaattattcctcctcggataaattaaaatgttctatattatgtatcctacttagaaattaacatctgattccataccccatagataagagattttccagagtaaacctaaggttgctagatcttttacagatctcagaaacataaatgcctcctagtcaacagagacaatgaacagctttttgttttttaaacttctaaaactatcttgggtctgtgctttgaagacagaatgaacaaaccaagtattctcttttccataaatctttctcctgtttgaaaacagctcctgtgcctctctaaagcttctcttctccagactctagctccatttttccaacaagctcactgtgctccactgtggcccatggtctctagataccatcccattcctgcacacattctggtttgttgctgttacagaggcccagatgttctctaacaagatcttagcacaggaagactttggtaaatgtccctggcattgatgtttgttattcatgcagcatagattttgtgtgcctgactacgggcttacagtacacttagcattaagcaaaactctcaacctctttagttgacccaaatcagttatcctcatcctgtataatggttactttccatttgcatgtagaacttcatatttatccatgttttactctttctcctggattttaacctggtagctttccaatctgctcaatcattttccaggatcctaggctaggctagagaccaggactataggcatagttgtagccacctgaagagttaagactgggaatcatgtgaatagaaagaagtctcaccaaaggagaccatgaagagacaagaggctatctagtttggctcaaggtaaaatatgtttaaatactttgagcttgccagtaagagaatggtaggcatggattccttggtactcaaggtagccaagtaagctggaggatcatctgtcagagatgggtcagtcagcaattcttctttggatatgagattcaactagaagttctcttagctacctgttacctctctggttctgtcctggtatttatagctctctgacaaggtttctgtggtaaaccttgtgtcacccctggcatcattctacctttatgtatgtatccctaccacactcaacagagagtcaactgagtagcaagctcctgagatatctataggatgatcgaaacatatgaggtctaataatcaagtgaaatgcatatcagggtttttgcctagaaaagtttcccaaaatggtgcttgaagagtaatgccagaattggtggattctaggaaccaaccaccttcctcctgaattcaaccaaattaacaacaaaaaatttcagaacaaataaaaaatacacaagaaactctaagatacaagaaaaggcaatagtctttaaaaatagtgactagagaaagaataaaaattactaggaataaatgtagagcttccacccatgataaccctttcttcttctccaaagaatcagtactgaaaggaagatgggagagaaaaaattcttacaaagagttcaataccacagaatagagagggaaagggatggagggggcaagtaggcagttgtcagaggagattcagaaagtttccctagaatagaaggttctccattccatcttaccagcatttcgaagagagaaaaaactgcctgggctgcctgccattttgcttttcttactgatgagaagaagagaggaaaggcagaatgatcgcacagaacacagagtggattttcttgaatgatatgaagggatttacaaggaaggaagactaacggtaaagtaaataaaacacgtccctctgaaggagtgaatggcaggagacacatggaaagccccaaccaccatgttctcccccgactcctgaaaaacagtggctaaactccttggatttgccgttttttccttcctttcttagcagaggagtagccgttgggaagcattgggtcaagtctggaaaataaacctacggacagcttgtctctacaattccaacctaaattggtgaaacaatctgaaacccactactaaccacctccaaaggaataagatatgcccccgatttggtataacaaactcacgttttggactatgaacagagttacggaaaaagagaagaaaccaattctacaaacagctctatcttaacttccccttttccccaccacctaagcagtaacaaaacaaacacaaaatatacaatcctcaactaaagcactaaagggaaggctaagagatcccagctaaggtaggaaggagtcaacaaaaactaacctacaatacaatatatctagggaaagggaatcaaggtagaaatatacaaatcagaaaaaaataaaaggaaaacagatggcatggcaactatacaaaaatactatagacaaaagaggaaggaaggtagaaaggaaggaaaagggaaatgtgcaagagacagatgtcaggatggaaacatagttgcaagaaacacatcaaaaaatgcaaaagtatgcttctgtgcaaaatatataccataaatactttgactctagaaaaaataacctgaaaaaaaattaagaaattagagttgggatgagaagatcatgcaaagatggaagatgattgctatttaaggaaacaaattaaagaccaaaataaaaggactaatcaagaaattgggaaatatacaaccaaccaatttattggaaaaatgaaggaataaagcagatatagcttcaagctgaattagaggagggtggtagagattgagtaatcataacgaatgcaaagaaggaaagaaagattgaagtatatggagataaaataatggacctggagttgagactctgatgacccatctatgcattatgttgtctccgaagcagtgaacaaaacaaatggaacaaaggacatattcaaagatataacagaagaaaaatgttcctcacttgaggggaaagttgaacccttcaggttgacagaccgcatcatgttaaaaaatatatttaaatgcttcatacaaaaaaaaaaaaaaaaacccagacatctacatgggaaagtgaagattaagaggtgctggaaatcagctggtcccagctttctccataactttaaatacaggggagcaacatctacgcagttccaaggaaaacagtcaaccaagaattttgtaaccacacaagctgtccttcaagaaaagacaaaattttcaaatgtgatagaactcagggaacacagcacctctgaactctttcaggaaaattgttggaaaacaaaatccagctaaacaagacataaatcgaataaatttgggaaagggaccagtggtgaacatgaaatctttttacatttaagtctaaggctaaataactgtggaaaccatggttacagaatatggaatgtaaatgttataaccttaatgatgtacaaagaagaattcaagatgtgtagaggtagaaatggaaatgtaggaagaaatgtgaaggtgggaagatattcggccattctcatcttttcctgcaggaagtcagtaggtaccattgtagtgactacatgttcttatcttccgtattcttgatgttctgtcacttggtgccttaatcctggagtgacagcccctctcaaggctagctaattcctagaaacaactctccttcaagtgtgtctttgaaatacaaaccagccaatccagaacccacacctgtaaacatcacctttatcaaattctcacgcaccaagccaatactccccctaaatcaccccagggccagtacctgacaactacgggccaccctatagcctaggtcctgccaaaattattcaaactagccaaccctaaacatactgaggatacctaccctgcctctacctttcctttccaagaaaaccccagtaaaggcttggggccatctctcccctcaccacttctgccttctgacccaccctagcccttccccaaggggctctgtatgatgtgccacacatcctgctattagggatctgtgagtataaacctattccttcatgagaatcatttgtgggtctctgtgtcataccatacctgattaaaacaaatgccaggtccaaagtttagattaaatttaaaacctataatgcaaaaaaactacctcataatttatagatttcatgccatccccatcaagctaccaatgactttcttcacagaattggaaaaaatactttaaagttcatgtggaaccgaaaaagagcctgcattgccaagacaatcctaagccaaaagaacaaagctggaggcatcatgctgtctgacttcaaactatactacaaggctacagtaaccaaaacagcatggtactggtaccaaaacagagatatagaccaatggaacagaacaaagccctcagaaataataccacacatctacaaccatctgatctttgacaaacctgacaaaaacaagaaatggggaaaggagtcctatttaataaatggtgctgggaaaactggctagccatatgtagaaagctgaaactggattccttccttacaccttatacaaaaattaattcaagatcaattaaggacttcaatgttagacctaaaacctaaaaaccctagaagaaaacctaggcaataccattcaggacataggcatgggcaaggacttcatgtctaaaacaccaaaagcaatggcaacaaaagccaaaattgacaaatgggatctaattaaagagcttctgcacagcaaaagaaactaccatcagagtgaacaggcaacctacagaacaggagaaaatttttgcaatctactcatctgacaaagggctaatatccagaatctacaaagaactcaaacaaatttacaggaaaaaaacaaccccatcaaaaagtgggcaaaggatatgaacagacacttctcaaaagaagacatttatgcagccaacagacacatggaaaaatgctcattatcactggccatcagagaaatgcaaatcaaaaccacaatgagataccatctcaccccagttagaatggcgatcattaaaaagtcaggaaacaacaggtgctggagaggatatggagaaataggaacacttttacactgttggtgggactatgaactggttcaaccattgtggaagacagtgtggcgattcctcaaggatctagaagtagaaataccatttgacccagccatcccattactggatatatacccaaaggattataaatcatgctgttataaagacacatgcacacgtatgtttattgcagcactattcacaatagcaaagacttggaaccaacccaaatgtccatcaatgatagactggattaagaaaatgtggcacatatacaccatggaatactatgcacccataaaaaaggatgagttcatgtcctttgtagggacatggatgaagctggaaaccatcattctcagcaaactatcgcagggacaaaaaaccaaacaccgcatgttctcactcataggcgggaattgaacaatgagaacacttggacacaggaaggggaacatcacacaccggggcctgtggtggggtccgggggatgggggagggatagcattagcagatatacctaatgtaaatgacgagttaatgggtgcagcacaccaacatggcacatgtatacatatgtaacaaacttgcacgttgtgcacatgtaccttagaacttaaagtataataataaaaaaaagtatattactaagtgaaaaaagcaaggtttggaacaccttgtataatatactacgatttatgtttaaaaaatccacttttggctgggcgcggtggctctcgcctgtaatctcagccctttgggaggccgaggcgggcggatcacgaggtcaggacatcgagaccatcctggctaacgtggtgaaaccctagctctactaaaaatacaaaaaattagcccggcgtggtggcgagcgcctgtagtcccggccgaggaaggagagcggcgtgaatccgggaggtggagcttgcagtgagctgagatggcaccactgcactccagcctgggtgacagtgagactccatctcaaaaaaaaaaaaaaagaaaaatccacttttacatatatgtctatatttagaaatgcttggaatatatctagaagttacactaaaacatagtgacagtggttgcctctgctactgggggacagagatgtaatgagacttactttttcctatgtctcattttgtactttttgaattttgtactatggacatgattatttataaaaattgaattaaaactcataccaaagcaaaaacaaaaaacaaaaaacaaaaaacaaaaaactacctcagtaactccaaaccctttatgcatttcataatacattttttatacttttagaaaccaatttctcttctttggaggaagcagttaccaaaattcagcaagtcttatagtttcacttcaagttcaattaaattctaatagttttaatttcaaacaagtatatctagtataatctccctctttttcccttcctccttctgtattagtggggaaggaggtgtttagtgtaagctatttttactttcttccttgtatttttcactattggttgaatttttagatatgaacataagccactttcaacaaaaagtaataaatttattttcaaatatatctcccaggactagctcattccaatgaaaatatttgtttctgaccatgtcagggacttggaaaaattacttttggagctctgaaagatgctctgagtcccaggatggttcctaaaagtcaaagctgctagttggggataaacttttttttacctctttcttctcagggaggcctctttcctgcccaagacctgaggctctgagtctagactgggggttttggaaggactgtccattcgatgtacttctctgcctcagcctacgtgtccctcaaaatccaggtccagatagccaactaccttctagacgttgccacctggttaaggagaataaaaatcatttcaagagccaccatttactgaacatcaactatgcagtagatacactttgtcatttcttacaatagtactgcaaataaaaaatagcttaaacacctccttccccacaaatacagaaggagcaagggaaaaagagggagattatactagatatacttttttgaaattaaaagtattagagtttaattgaacttgaagtgaagtgaaactgtaggacctgctgaattttggtaattgcttcctccaaagaagagaaattggtttctgaaagtacaaagaatgtattatgaaatgcattttctggagaaactgaagctcagctgagttaaagtgatttactagggtccagcttatcagcagtacagccagaatgcaaaaccaggtttgtctgttgcattcaagctgctttccgtgggcatttgacatgtccaaactcaaattcactgtcttccttctcaagcaaactcctcctcctgtctcacaattcatcaccctcacaaccatgcagacaggtgcctggtggtattcctggtctgcctctcaactccatctcctcatcaagtcctgacaagctgatctccaatagctgtcaaactatcctgtccacatttactaccacctcattacctctcaccaggctatttccctatccttttacctggtgtctccctgtctctagcctctgctgtttcaggccagctctcacaatctgtccagaagaattattctaaaatatagatttgatcctgatgcttccttacctgcaggcttctctttccaaagtgtcctaaatgaaattcaaactcattaattggccttcaaagccttcaatttccttggtctcagcccactgttcccaccttgttgcccatctctctgggacgtgtagctcacacttagttcacatgacattccttctgttcctgaagtatgccaagcactagaagatgcctacatgcttttgcttctgctgtccccctgcttgggatgactttctcttccccagctcaaggtggctcctcctgaaaaccttccctgactcaaccccactgagctagctgcttcttcctctttgttcccaggtactttatggcctgttaaagttttatcacaatttatcgtagtgactttgtctattcttatgtttcctctcctagacagtgagcttattcgttcatacatttgtttaatgtttattgagtgtttactatgtccctggcaatgagctgggagctaaggatacaatgctaagcaaaactgacatgccacatcctctggagctcattattcaggggaacagagattaatcagagaaacatccaaacaatttcacactgagagattttacaaaggagaagggatccgaaggtaccagcaaacccttcccaagaaaagtgacatgagcagatatctaaagattgagttgggagttcattaggcaaagagggagagaggaagaacattccatgcagaagacagaatgtgccatgcgtaagaagaggaaagaatgagctgccgaaggcaggccaaaatattgtgagtgagagtgagtgtggccctagaatatgctggggaagtgggtggggttaactattcagggccttgtaggttctactgaggattcaagtgctcttcctaagagcagaatgaagcctctgaagatgctgaaacagatttgccttctagagatccctgcggctgctgtgttggccatggtgtgagctgggttgggggttgggagtgcagggagaggggaccaggttgcaggctgttgagttagccaaggggactgataatggtagctgggacaaggccttctccctgatggtggggcctgaacccttttcacttaatgcatccccagcacacagcctaagaactggcccacagtcagtctcacatatttggcttgaaataacctgcaactgatcaaagatcaaaacagcatacaatatagttcctgagaagggaactgattgggttgttggaaagactagatgcagcacagaaatgagcctcccagtcctcacaaactgaaggagagccaaaattcttcagactccagaatgttctgataagtatcttttcccatttctcaaaggaacagccaacaaccatcataagagactggatttttccccatgagttcatatgcagggctgtatttagtgcctataaatacaatctgagccagctctcataaaatgctcccaaagccttttatcctgggtatgggaggggacggggctctttgatggggctttcagaatataagaaaagaaagtcacaagtctgcaagtattcattaaacacggagggttgcccaccacatctctagcactgtggagcacagtgtacaagaatatcccatttggttggcaagatagagttctacaacctaaatgacagaaatgaaaatgtatgccaggttcctgctggaataaagaccagtatcacatgcaaacattacagcagcttagtgaagtaggtactgttattaacctcctttaaaagatgaacaaactgaagcgtggagagaattagaaccttgaccaaggctatgcagctggtaagtgatgaagtctgagctcttaagcatccagaccctagaactgagagaaaatgagagggagtgtatattgttggacactgaccatggttaattttatttttaaaatttggtgcttataggagtcacattcatttgcctgataattttacttctaagatccatcttatgccctattaatattggataataaagttttgctgtaggtagtggatgtctaaattggtataattttgtaagctaatctggcagtgtgcacatatacatttaaaagtaaatacttttaaccaatcaattgcaagtctagaatagtagcccatggaaaaaacagatttctataaagatctatgtaagatagtattcattataacagtgtttttaatagagaaaaaaagtggaaatattattacaactggggagaagtagtatttttataatgattgaaataatagaagacttctcaaagggaaagataggcaaacatgattatgtaaaatctttacaattcctctaaaataacacaaaacgtattaaaaagcaaaaaaaagattgaatgaaaatatattaaaatacagccccccccaaaagaaagaaagccaattaagggctaatatctataatgtatcaagtttacatatattaccaacaaaaaccaaacaaatcaacgaaaaaccccagacctaaatgggtacacgggcaaagatgtaagaagttaagtcacccagtaagaaaacaaagtgactattttaacattttaagtttgagcttcctagcaaattaattgaaataataatgaaatttcacactaataataataaacttaaaacaatgacaattattgattattcttactatattctgaataataaggagcagaagcaaacaccagcacgggtaatgcgtaagagaaagatgtccattcagtctttgtcagtagcgttattcattgtaagtaatttgggaaatgcaaatgtttctactctttaaccttgtgattctcaagtctgaacacttatctcaagggaatgatttaaaggaagaaaaaagaacaactaacggtccataattgtttatactagcattgttaatcctagttcaaagaacaatagataggtcaatacaagaggaactatgcacccattaaatcataactgaggagaaattgctgagtataaaataacaagtaaaaaaaagaagctgtatctattcatcaaatcaactgaaaacattataaatatgggcaaatattgcaaagaagaaaaattgttagtttttcagaattgatggggttgtgggtgaaattttaaagtgttttttccagtgttttaaatatgctttagtaaatttaaaattataattagagaagtatatgctgcattttcaaaagatctctttaaagatggttatttaaaatattttgcccttgggaaaaaacactgtttgaaattttacttctgggaaccttcttattaatgctgaataaataggtaggtgtaagttactacagttcagaccaggggcttccaccattgttagtgacatcctggacacattcacccaagaatccatagggctcttatgctgagactggcccccagcagcttgaagcggggcaaggattttcaaatggtgctctgtgaagcctgggtccctggaggtaccttgggcccacagtctcagaagatgaaggatccaagcccttctatccccttcaaccagagcagccccatttgcatctccccaacacgctggcctcctacagatcagcttgtctgaaatgttgtgcagcttaaaaaaagttttaaaactgttcatgagatggccaaaccatgagatttggagtcaggagatcctcgggcctcagtttcctcaactataagagcaagaatccctgcccctcttagctgactgggaagattacataaaatcagaggtaacaaaatggtttatactgtggaaaatgctatgggaagtttattaattaagattgaattaaaaggactaggtgacacggatgaaccttgaagatgttttactaattgaaatgagctcgacacaaaaggacagatactgtatgattccatttctaggagggatctagaagagtcaaatacatagagacagaaagtagaaggtgatcaccaggggctggggagggagggaataaagagttattgttttaatgagtatggcatttcagtttgcaatgatgaaaacgttctagaaatggatagtggtgatggcttcataatatgaatgtacttactgccactgaactgtatacttaaaaatggctaaaatggcaagttgaatgttatatatatttacaataaaaaatagtcccccaccccctctgaaaaagggagtactatatagagtaaaatacaaaagaaagtcaagaaagtagaagattgcagagctggtgggactaacccactgctttaaggaacaggtaccatatgactcagagaggagggagatagcccagcaggagggagatgccgcggggacagaggcacagaggctagagggtgagtggccacagagaagaggctctgggaagagggaagagccaggagcctggcctgttggaaacactcatctctctccactcacccatgcctctttgcccacctcatggcactatggttacagttacaaattattttcatgtacctatctcaatgctcctgccacatctttttaaaaatgtttcttttgagacaggatctcactctgtaccccagagcgagaccctagagtacagtggcacgatcacagttcactgcagccttgacctcccaggctcaagcgatcctcccacctcagcctcccgggtagctgggactacaggtgtgtgtcaccatgcccaggtaatttttgtattttttgtagagatggggcttcgtcatgctgcccagactggtctcaaagtcctcagctcaagcaagccacctccctcccaaagtgctgggattacaggttcacctagccccctgccacatctcatacaatttcattcgttcattcaacaaatacctatgcaggccctagtagtgccaggcattgttgtaagcagtggacacacacacacacacacacacacactcctgcccttgggggcttcttctctagggataatagctgacacctagataacacctgtcatgtaccaggtattgttttaggtactttatagatattagctgctttaatctccataatcacctaagaaggcaggtactgttcttagcctggttttacatgcccagggaggttgaatagcttgcccaggtcacctgagtggtagcagggcttacagttccaactcgtggtggggctcgacatactcatgcaggagaatggggccgaggaagggtgttgggggcactgggagcagggctggacttgcccagctagatctagaggggtcagaaccctactgagaacatcggcagaggtgagtgcagagagggaggcagtgcgggggctgaagcctcattttcagaaccattttccccgccatggttctggcagaaggtggacagggaaccagaggcttggaggaaggggcctgcagctacccagcagggcagggctggggtatggactttgtggtgacagcagattagtaagcaagagatggccgtgatgccttgaaaagaggaactcttcagtttgggcagcttcctgggtgtacgaggaaaaggaagtgtcaaaagttcaggcctgaggcacccttccaggcccactagatgccagcatggcttagggagggctgacagcgaggcctgggggctggttggaaggaggcaggtttggaggtgctgagcgggcagaagacacaatcggattcattcattcaccagcaaatgtttcctgaggaagacacaggaagtcttgtgtttacacattcaccttccttgatctggcacagacaaatcagcactcgctgagacagcatctgccccaaccccacctacctttttcctgctcagctgcttcactaaggtctggaagcttgagccccactaagttctgatttctcatcaggatgtgctcctttgtggtaaaagaaagagataacaatttcagatgatgacactgggctgggctgttctcttggctctgtctatggttctgcgaccactatcttaggtgggaaagcggggcagcctgagaggtgggtgggcaggcatggcatggtgaggcctgagaagcaccaggaaatagttcctctcccagtccgtgaaggtgcctgaaacgccactgtcagcaccactttccatgggtcagggactacccttggcatggtctttttaaacaagtctgtgggcttcagggtaaatgaactgcttggcctcactgtggctgaggtttgcaaaggacacacaggggcagaactaagggctctgggacaggagggtcccctgggtgtgtatggcgctgctcctggaaacagctttggcgatctcatggctggctggatcttcctgccctgtcattccgggcagtgactgctcacttccaggagctgcgattgccccacacactcaggtcatcaatggccttttatggcacctcttgagtttttaaactctccagaaaagtgaggcctgagaattgctggcttagggcctcagctggcagagcccggggagagatgggatgtggcccaagtgggctcacacctgctctaagccaattagcaccagaccaaggacctgagtggaggcacctggcagagctccttgcccctgtgacttatggatcttcagtctgctgtgtggcagagggcacttgggaatggtttgtcccccgagaagggaggaaaggaaggggccagcagagggtgctcatgatccaagtggaagtcatggtcaaggaccctttacccatttggttagcaagccagaggcccacagcccatcagcttcagcacactggagtcgggtaggggctgggcactcaggtgccagggtagtggttagtgacatggggcctccaggttccctgtaacttctctgggtgggcgaaatctgcaggagtgtagggagtgaggaggctctgataaccagaggcccatgaaggcaaatccctggctatcggccccttggctccaacttccgctagagatccgggactgtggcaactcctctgggccctgtgctgtttgatccgctagttagttgggtctttctgactaggaggagttttgtgtgtaaaatgttaacatcagcagccacgccccagctcccctgtgcctccagttcagagcatcatgaaggtatctgaataggatagtggccagcattggaatgtgtccctgccagcacacaaatcccctcaattgtgcttgagtgctatcgggcaccttcttttcttccctgccccacatttccctctgtagaggagccaggagaagcctcctgctctgagggtgctgggcctcactctgtggaatccaggtgccttggtttatattccaagtgggccttctggaggagacaggactggtcagaattgctttgtcctgttatctggtctctatctctggatgcccccaatcataccctgcatagggtggcaaccccacaggagaccgctgtgcctggtttgatggccaacagaagctgaggggacaccatgggcactggaagaaactcaccatgggcggagcagccttcacacttgcagatggacttaaagcttttgttaacaggcatcaggaaggaaggcttgggggcatcacaaaggaaatcactatttcacccttgctagctaatcctaggcatgactgggcactccatcaagggattcctgtttatgagccactgactccggttggaggaggaaagcagcccaggactgaggggcccacatgtccctccacacgtctgccttcccctgagatgtggctttgtgtggcaactagattttagactgagctctgcctggtaactggcataaaaaagcacctaaaactggtatttaggaaagagatgccacataaataggcctgacttctcagagtgggaaaatttacgccctcacaaggcccaagtccaggccagagctgccctggccaggggcccagactcagccctgaggtcttcagcccagggagtacctggagtacacactctgcccaactggcccccaggaacccacctctcggagcttggtcagtttctgcatccgcacgggctgcacttgtatctgaaagtctttgagaccaggggccttggccagcttgccgccggccttgcctgcaaaacgcttttcttcctctgccagtggcagcttggcaagcactttctgcagccgggggccaggttcttcagggccactgtcccaggagagccctcgcagcagcgggggccgggacacagtgggtggaagctcagctttggagccagcctcgggccccatcggctctccagctgggcctctcccctgggaggctgggggacccactcctgccgcatcctgggttggacttctcggcagagggctgccctcccagcccgttttcaagagctgcttccccagctcgctctccacggggccaggctgagggctgttcagggccattttcccactgctgtttgtaacaggagctaggcctttgggtgtggtctcggggtactggaggggatcgaagttttccttttgttctattgcaatctctttggacttctcaactggaggaggacgaggagccagcctgccctgagacactttcctctggtcattctgcttcctgtcagctagccctttggggacgttctgaaaaagacaaggtagagctggaaccctcgggggcaggttgaggggaaacaggtgaggccacttctgctgtggagtctctgcccccacacaccttgccaaggggcccatttgtataagtgtgtatggggtatgagtggacgatgtggaaggagagggcttctgcccgaggtttgtcaaacagacaggaaaatggaacctgcaatccaaaaccagccaagaatttcccaagggataggagctgaggaaaactgaatagaaggcagctttggccctaactcagttgccccagatctagccttggtgctgcttagcaaggcccttaactcttagggacccaggtttgtgaaccctctgaaattatgtatgtgtatgtctgtgtgtggaggggtgtttttctaggaaaaacatccacagctttcaacaatttctcagagttccatgatccaaagaggttagggatcattggatggggtgattcttgcaaaggtgatgtcttcctgctcagaagctctaagattctgcagtgttagtttactttgttcattccccaagggaaacctgggccgtgagcagcacgtgggtctgggggtctgtgtggctgcctcgtgtgtgctgagactcttccagaggactgtatcccagacccagttccaggtgacactaaattctactgctgcccttgaaacactgagcacgtgggcccctcgatgtgagcagggtggggcgcttctgttgctcatcaacaaagatgaggttttcccggcttccccagacagaatcccaggcaggggctggcgctttcctgcccttttcactggagctgacaggagccacagtctcacctggcctggaggtcccccttgtctccaaccagcagcctgactgggggtcagcgctgtgagtattgcctccacggagttcacccccctgaatcctgcctccccacccctccaccttagacttctagtcactataaggcaggggaatctgctgtttccccagccctgaccctccactcatacgtgtgcatgcacacacacttgaaggctgcccaggagccagcctaggcttctaggagactgtgccccccacactcaaatcatccaaagggagcaaagctcaaactcacaggctcgccagggtgaggtgaagagacgtcggcctcatcccccttctgctggagaaggtgaacaggagtcagtcagcaatgggaagagaccgtgtttcctcttgaaatatccccaaggaggccccctagcagtggtgttcatgccctccacccagcaccctcatctccagtgggtcacgaagggcctcctggtgttcggggtaaggggagagacccattggcatagaaacagcacagcaggtggggggtcctgtcacctgtggtggtgctccaggcagaggggatggcgggccactgcacacatccaaacctggaagggtccagacactagtgagtgaggcccagcagcccaggccctcagctgtgctttcagccacatctccctccccgggctatcctccctttgcaatctcaggcctggaagatttgctgactacctcccgtgtgccaggttctcaggtgggccctcacagaatgttcacagagaccacaggaggaaactgaggcacagggaaatcaaagtctcatggccaggaaatgtcagcactgagatttgggcccaggctgcctggccccgacctgagcgtgccctgccgcactgatgagggccggttgcccttcctggcaccctccccctttccttgttggctggagggtgtgactctgggtacagcctaatgaaagggaagaagtcagaccccaaagaggcctttctgtataagctcttgagggcttctctgagcctccctgagccagagaggctgtcctagtcccctttcccacccagccttcctgaccctggggtacacctgcctcccgacacaagcccaagatgctaacagaaagtctatctgcctcctctgggtggcccagcaaatgccccccctggagaggggtcttgctctgggtgtgaaggggccatcagagttcttgaaggggaagcctgcaggctgggaggcatgctgatctgtccaggctgagctgccacccagagcgagaggcagggcaggaagtccccgggcagctgggcctcacctggcggggtggggactgtaagtgagttgctccgagaggatgtaggagaagcgctggggctgaggttcggggaaacagctgtgaagacagacacaaattggctggcattcatgaaggtttaggacttcaacctggcaaaggcatccttttaggtattcccaggccctgggaactgggtctgccttgctgggctcaggggctgatgctggactgcaatatgatgctcctgttacagcccaacccctccctgctgctgctcaagagatgggtgccctcaggccatttgggggttcgaggatagagtcacacttctcagcctgcctggcctgacctcaaggcactgtccagaaactgaggcctggcgttggttggcaggtacagctccagaggctgctccttctcgacttcccagggtggccctgacttcaaaagctccccttgtcctcctaagtacacttacacacttgcccaactttttgctcaggaagaaaagtgactctagcatagaggaagcaggaggatttctgggcccaggaaaaccttccctctaacccagaaattccccaaagaccatctcctcttccccagagggcctaggatccttcccagcacccacagagatcaagggaagggagcccaggacagaatcctgacctctgctgaggagagcaggtgagtccaaggcgacctcctcggaggtgaggcgcccactgcagctggtgccaggcccttccctcccgaccctagaggggctcagggcagccacctgtacatcctgccaccctacctgatggggagtctccggggctgctcctggacttcctcccacggcgggtcaggaatcgctcactcaccaacttggcttcttccagcagcgccaggtttttcttcttgtcctcctctgagatgctgatgtctggcagctggtcattcaccaggtcaatgatgtgccccgcggggtctgcagaaggaggatgagctggggtgagagccactgcatccgtggccccaggctgaggtcatgccataccatgcctcatcccagggactctgcccacagctgacccagccagccaaacctcagcccagtgccatcaagagggttgcatggggacagacagtggcttcctctgcaggcctggcccctatggcttatggcctgtggtcctccgtcacaaatggtcctggagccatctcaggttcccagaattttcctaaactctgtcaggaagggaaggccacccaggagccttacctccggcaccatctgcgcccccagtgcattcttgcttctggcctgtttctttcacaagctaatgcgcttaaggtttgtgaataaaagaaggagaccaaagatcattggccacggccacaaccccgtggccaccttccctccagtcacattgttcaccccatttttctccaaaactgcccctctggatgaggtgggtgaacggcaccacctctcacctggctgctcaggatcacaggagtcactccccacttctccctcttcctccctcccccaacatccaatcagttgatcaagtcctccctgcatttacctataaacatctctggagcctgttcctcatctccattcttgctcattagctcttttttttttttttctttttttgagacagagtctcactctgtggcccaggctggagtgcagtggcacaatctcggctcactgcaacctctgcctcctgggttcaagtgattctcctgcctcagcctcgctcgtacttgttagctctttcctggacaattatgtcttctacctaagaggtccctgccctcaggcgagctcctccatcccatcccccactgcctatcagagtggctatcagagccacatctggccatgccattctccacctcatctcatggggatttctcatgctcctcagtgtggtatccaaaccctaaactgggctcagccagtcttgctggcccccacatactcctcccaagtccctccacttcagctgtgtctgcagtgaacagctcccatttcacctccatcgggttccattcgtctttgggcagcagatccttggttttcacttggtaaaaacctctctgattccccattagctaacccccctcccctgtgccaagagtgggaatgtggactagtcttggccaatcaatgaacagaatccccttggccacagggattggctcggggatggccatgtgaagccattgaggggcaatcctggtgtggagtatatggggaagaagaactctccactgatggggcgtaagcttggagttgctggtagctattggctaccatgtgttgaagagtctgccaagaagaaagctaacacacaagaaaaaaggttcaagagatggaatgggacaattgctaataacccactttgagcacctggatccagcactacctgaaatcacaagccctggcttttgtaaatttttttttggtgtgaggtagtttgagttgggtttctatcatttgaaaaagtcccaattggtacacatggcagagtttcagttgccagcaacatgctccagggaggttcctgctctttcagtgtgtttcctattccccctggaatgcctttcctccctcgcctatctgtccagctctctaaggcacaactcaaatgccacctcctctggaataccttcctaaaacttcctctcctcagagagactcggtccccttcttgccttggctggcctagctcttctgtgcagtctcttatcatacagtgtcccaattatctgttcatttctcagtctcttcatagtctatgagcagcatgaaggcagggaccaactctatatgagatctatgttccaacagcccagggcagatcgtgagccaccatctggggatgagcagatgaccagggcagccggccttacactcaggcacctactccaacctggatgtgggcctctttagcagaggctggaggactctgccccctaaaccccagaaatgagtttcactcagctgttctttctttctttgacttctgcatcttcctcttcatgccctggtcttgtcttttgagcaatgaaaactgaattaaatatgcttctcctagacccagacacggaggggctgatctaccctgtcctgttggacttatcgggagggagcgccttaaagagcaggagagaggaaggagtcaagcccagccacgctgccagacctgtctttctactcaacatgccttagattgccctggtccttacccacagatgtcagggaggcagtggacaccttcaagtgtcggtgagaaagcctcttgtggggactgtgaactctgaaagacagaacagtcatcttgttcagaaaatcaatccacaacttgaaaataggtgaaaagatgcctgtatattctttttctttttctttctttctttctttgtttccttctttccttctttctttctttttttttttttttgactcagttttactctgtcacccaggctggagtgcagtggcgcaatctcagctcactgcagcctctgcctcccaggttcaagcaattctcctgcctcagcctcccaagtatctgagactacaggcatgtgccaccacacccagctaatttttgtatttttagtggagatggggtttcaccatgtcagccaggctggtcttgaactcctgacctcaggtgatctgcccgccttggcctcccaaagtgctgggattacaggtatgagccactgtgcccagccagatgcctgtatattctttcaaagtcatcctagaacatcatcttacaagcttctcgagggtttctctgactctcaacttgggaacgtcttagaaatgcaaattctcaggccccaactcagatcagaaattctggaggtgggcccagccagctatgattttacagctctccaggtgattctgacgcgtgctaaagttttccaaccactgccctaagaggatgtgactttgacttactatttcctactcattaggtcccagactctgagctaacatctaacttgtagaagcctcataaaatgtaaatcattgttgtctgacaaagacgcagatgatttctgtttgggaaaaaagacaaaaatatggtttcattgccctgtagaacattcacctattttatatctaacttagcagttttattccagcactttcctccccactgatgatatatgtatatccattgcttgtatcctcctttgaaccggctttgttatccagatgcttcttgtattaatgaggtaagtaaatctttgacatatgctcagtatatttatatgagaattatctttttccttttctttttctttctttctttttttttttttttttgagacggagtctcgcactgtcgcccaggctggagtgcagtggcgcgatctgggctcactgcaagctccgcctcccgggttcacgccattctcctgcctcagcctcccgagtagctgggactacaggcgcccgccaccacacccggctaatttttctgtatttgtagtagagacgtggtttcactgtgttagccaggatggtctcgatctcctgacctcatgattcacccgccttggcctcccaaagtgctaggattacaggcatgagccactgcgcccggccgagaattatctttttaactttttgaaaattagacagtctcatttcagcgagcccagttcgtgggctagtgctctgtgaaaccaaggcggagacattcctctacctgtgagcccatgtccctgccaagagatcatatttcacacgttttggccaggggcaggattctacattcaaacacctgcacctttcatgtttggctgcaaatagctggacagttattatgggaaactctcctgcggtgatttatgcttttcttaaaggctagccctttccatgggggaacaagtccttctggggcccctgggcattaaatgttttaacctccactagccctgctgggggaggaggctgcaaatgggctggagccgtcgcagagccaaaaggaccacatccaggagaggaaaaatcattttaggaggaagataatggaaaaattcctatttctatcttgtattttgaaaaactgcttgattatagtttagtcaataaaatgatacaagaaaaaagaaaagatttatttaaaaatatagctgtctgatcctcatgttctaggaaatattgtttgtcacaatgcaaggatcaggcacctgtacctgttggccaggtttttgtcggtttctccttctggtgaagtggcatccccagtcaggacaatcgtgggagttggactgcaagatactcctgcggcaggaggaccctgccggtttagaacaaaaacacagagttaggcttgggctggtgggacttccagggacaggagccagagcatttattctcacatcatgatgctcagagccatcttgataaggggacaaatgcagtttactctttattcccccagctttattgaggtatagttgacaaataaacattgtatatattcaaggcacacaatgcgatgttttcattaccttgatacaatgttttgatacaatgtgacatattcacggcatacagtgtgatgttttgatgtgaaatgattaccacagtcaggctaactaatatatccaccaactcacatagttacctttttgtgtggtggacaatacttagcaaattccaagtatacaatacattattaactacagtcaccgtgctgtacgttagatccccagaacgtattcacctcataaccaaaatagtaagttgaattctttgaccaacatctccccatttctcccacccccagtcactggcaaccaccattctactctctgtttctgcaagtttgaccttttaagattctacatataagtgagatcatgcagtattgtctttctgtgcctggcttatttcacttagcatagtgtcctgcaggctcacccacattgttgcaaaaggtgagatttccttctttttttaaggatgaataatattcttgtgtgtgtgtgtgtgtgtgtgtgtgtgtgtgtatacagacacaatattttattgtgtatatatttttcacattttttaattcatccattgacagacatttagattgtttccataccttgtctattgtgaatagtgcacacatataggttatttggattactcagaaaacaaaaaaggcagtttctcctttattccccagcaggccctcacctgagcttaacacggtccactattcatgcactaagattagggacactacaagctatccctggttagttctcactagcaatgcaggaaaagaatggtacagagtcctcagattgaggccagcctggctggggaagaatgatggcctggggaaaaggtagtggcacccacacacccctgaggttccacgacagtcctacctttgggtaactttgacatttcagtgatcgtaatttgttagaagactctcctggggttttctcttaggtccttccatcaacttaagagggtgcctgtcattttccttctcctccttcccacccccttgactggcatgtgctgccactgctccctctgtgagcacctgactgcctttgccaaaggcctgcctcctagcgtcccagagcatgttgctgccacctccactattggtgctgcctcccgcagcttcaaagcagtgggtgcccactgtctctattgccactttccctggtgggccaaatccttctagagcccctgcatatgaaatgttttcacctccactagccccactggcggtgggagctgccaatgggctggagcctctggcagagccaggctgtgttcttgagccttcagtgtgcaggtgttggttccctgcaaggtagggaggaggcctgctctccttttgacattatgccttgttgtgaaatgggtctcatacagtgctatctggacttcttacgtcccacaatttttagtgaacccagcttttcccattttcattttcatctcttcccttctttggccccaagcataaggccacatgagctggagaagtctctgggtgagagtccagctggggagcaccatgctgcttctcttgtggaaaggatgcttttatgtggaaacccagagccagatccttgaggagatgttcattgggctctgtgttcttatccgggagcgattcagtgcagaaagctacagtggctgaaggaagaggaggcactcagaatctcccgggacatggaagggaagcttgggcagggacgtgggctgtgtagaagcagaaggaagcagcattgcctattggaagggtcagacaaacctgggctcaaatttcaactactagctatgtgtcgtggacaagttatttaacctctctatgatccatgattataaagtctaactcacaaggttagtgtgaagattaaaaataacattgataaggtacctatgcatgattgacatttttatttatttaatttatttagtttcttcagtgcagtggcacaatcatagctcgttgtagcctctgcctcctgggctcaagtgattgccctggttcagcctcctgagtagttgggactacaggtgtgcaccaccacgcctggctgacttaaaaattttttttttagagacagggtcttactatgttggccaggctggtcttgaacttccagaatcaagcgatcttcccacgtctgcctctgaaggtgctgggattaaaggtgtgagccacgatgccaggccatgattgatattctaaatgtgctaagcatctagcatatgattaatgttttaaataaatgtgtacattactttagatttctttctctttcaacaaacactttatggttatccaccatgtgccaaaagcaacttgagatatgaagagaagaccctaaagggctcgcagtcaagcaagggatacagggaagtaactcataataaatataaggaaacaagggatggaccacattctgtgaaagctcagaggaaggaaaagaaaactctttagtgaggggagttaaagaagactctatagaggagtggacatttgagctaggtcttgaaggatgaataggagcttgcacgacaaagatgttagaggacaggatttggccaaagggaatcgcattagcaaaaggcattactgggaatcagggatttgtcagtgtagctggtgcaggtgcatggactatgacatgtgagataggagaggtcagggctgggggaattgtgaaagtacaataagagattgagccagcttctgaaggacctcgaagctactctaatgagtttggtctttatggttttggagatgggaagccctgaaggttaggcttgagaataacttaactacccaaagggaaatacagaaatgttgacagcagatcatccatgcatccctctattcacactggttgagatgacagaagaggcccagttattagaacatctatcatcccctataggaattctgaggagctccctggtaaataggagctgtgtctccatttggaaacctagagctggccaagagggagtgacaagaagtcagcacgtgcttgtggctgaaaccaagactggctgacctgtcctcatgatcccagagctccagtccctctgaggacacagatacccatccttctgtcaaggactccccctagaagagacacccagggagttttctgaaaagcaacaactcattctctggatagtatgccttgatgggctggtgataagcttgtcctcctgtggctttatccctccgttcctataatggcacaatggccaaaggcctgctctctctcacaggaagattatgcaagtaaaaagaaatgacgaatgtgtatgcactttgataagtgtcatatggtctacaagtacccttgagtcatgattattattaaaatgaatgatggctctattcaaggtgagccagtttttcccatcttttgttcagtgggctcccctggtgggaggccagcaagcagcagaggctggggtttccaggggaccagaagagaagtggaacaatgatctggggccccgaggacatgcagtggaacagtattcacaagggctggggaggttaagaaggggaagcagtgtgtcaaatggcaggtagccagatagagggggcagcaggcagggccaggggcaggtgccaagctaaatgggagagccagggaagaagaaggaatagggagttttctactgtgtgggttttctggtgagtaggaagagctgaagtctttccagaggaatctcttcacatcattaaaaaggagtagcattagcaaaaggcattactgggaatcagggatttgtcagtgtttctggcaggtgtgatctcttggatgtcaattaagcaatcagcatcctctgatgcatattctgagctcagaggtgcaaattagagacccatgtgcctgtttgctagtagtgtttacaagtttttaaattagttatcaacattccataattgtaagaattcacataaaggtctggatagcctgcttttccttaaactgaaagatcaaacaatcttaggcccatatttctgcagagtaaccaggtttgagctatcctaaattggctttcttcagtgatttgtgctccctggccccaaatgcatctgagttactgccctgtgtcatgtagttttcatcctggcctggttttccagagcacaggaggtttgtgcttaaaatctctcccacccacatcatctgggcagcctcatgcctatcaccatgggaacgccaatggaaactctgactgtgcttatagcatgcgcgggcttctttccctggattttattctgactgtgaaaatttgagctctgaaagttgcctttttcatgtctgtcatatttagagaatttctttcttgtatgagtcctctgatgaacaagaagaaatgcattttgtctaaaatatcattttttacatgcattctatcatatggtttccaccaccccttgtggtggggctttacaaattcctggcatgcattgatgaggataagctgtgtctatttaaaggggcaggatgggccaaacatgagctaattccatgttgtattctgaaaaaataattgtggtggtattaggagagttatagcatatatccatttctaacagtttcatatattcaggctgctaaataagtaaaatacatattttattttatttttatgtattgttttgagatggaggctcactctgtctcccaggctggagtgcagtgatatgatcttggctcactgcaacctccgcctcccggtcaagcaattctcatgcctcagcctcccgagtagctgggactacaggcatgcaccaccatgcccagctaatttttgtatttttagtagagatggggtttcaccacattggtcaggctggtctccaactcctggcctaaagtaatctgcctgccttggcctcccaaagtgctgggattacaggcgtgagccaccatgcctggcctttgtttatttttaatcttattgacactatctacttctcaaagcaacttgaagtaaccaacaataaaatataagatataaaaacatgagactatataaatgggggaatgatggatgatttgacaaacataaatatccctagcagacaaggagaacctcatgctcctaacagtctatggttgggagttgtggttaaactatttgccctgaaacctaatgaagccgtgatccacgtggcgcagactctgagaaggctcgccttacggaactgttcaacagaaagaaaaccagcatagaaggaacttcattctttactctcacctctcaaagaacatgaaaggggaacaaatcttcactcccatcctgacctctcctctgcccttttctctttccttaacgattctcacgccccctctctgatgactcttcccctgcttgcctccctgcccagatcctctgtctaccttctttctctttttctcctgctccagcctttactcccccagctccatccagttattttttgtgcagattgtcttcatttgtttgtatgattgactcacaaacatttactgaagagtcttacagagcaaagaccttcttggagaagagaggggcactgggctggcaatgatcagattctgtttggcgtccaagaaagggatgtggtctgtgaacactcccacattattggaccttattctgtccaatcatccggcaaacatttattgaatgcctattgtggccagggtctatgctaaggtctgggaagacaaaggtgaactgagcgggcctctgcaatgcttcccattcattagcatgaaggaatggggagagaaggggaagtaacctccactgctattactaatagtgccctcggtgttgatacctaccaggtaaatgggtacaaggcacgggagtgagctgccttctgataggagctttctctgcttgctggctaatggttacctgaagcaaagctctcctgactgtaggcatctcactggggaggaggaccatggcagaggtgcccatacaaaaaggcagaaacaagccatgggtggcaagtgccaagcaggtaaccgcagacactcacaattccaagtggcttacaaagcaggaagcataaagcgattaggaggaaatcctctaatcccttgatggaacatcctggaaggttcttcacacttgccttctaatgtgtgcaaaatacacaactcataaaatcatagtgttctttccctcatcagctgacagaatcgttgagcaagctctgggcaacttctccttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggcaggccttcaagaaagcttgggagagcagtaagaccaaatagcgttggccagacaacctactggcttaggggcttcagggcctcaggctcagaagccacactaccttatggtatactttttagctggataaccttgggcaagttaccttgcctctctgtgcctcagttacctaatctataatggaactatctcacagggtagttataagaattaaacaagttgatatagaaataggatttctggataaagcacaggatgccccagttatatttgaatttcaaatgtacaacagataatttttagtatgtgtgtctcaaatattccatggacataactgtattctctctctctctctcgactgaatcttgctatgtgcccaggctggtctcaaatttctgggctcaggtgatcctctcacctgagtagctgggactgcaggtgtgagccaccatgtacagcatataatcatattttcattttccaaatctggcagccctagatggcaagcctgtggaagtgcacctagcactgagcaaatgctcactaagcattagatgttatgttcccttattattcccttcgggattgaattaatgactttggcatttggttttgaaaagatggttgctcttagttctgggtctcctcaaccatctggagttaaattgggagagcccagccactgtggtcacggcgcaatggagcatctctcctggggcatctgaccacataagcccaagtgatcaaggacccaccaccaaggccaccttcacccggctccactccctctcaccctctgcctctcaaaccaatcaatgccctttgtgggttacagacatggaagcacagaaacaaacatggctagagggaattggcagttactcaggcccactgtgtggtgggccctgtcccagacccccctcgtgttttctcaccgaatcctcccagaaactcagtgggtaaacctgaggacaccacctacaaattgggggtgataatgcctcccaaactcatagaattgtgaagaggaaacgagaagatgaaagtgaaggccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctcccctggttcctggtgccctgctggcctctgacactcttattcttccaagctgcactctccttcacagaaggtacctcttcctccaggaagccctcaaaccagcacaaggctgaacacacagctggagaaaaggacagcatgggcagaggatgcccttggctcactgcccttctcactcctccatgggcccagcctccctgggggtccatttcccttccctggaatcagccaagcactgagggctgggtcatctcccagcaagctcaccctctaataagccagcaggccacattttgttctccttaaataaatcttatagaaacatttaaatgtttatttcactcatagattctcaggaatgcacaatagttttcctaaccgcctgggcacagggataaatataggccagtgtcatagatgggaatattagcttcctttccccagagtcacatggctaggcccaggctaggaaactgtaaggaacacccccagccccagctccagcccactccagctcaggcaggcatggggggtttagatcctgtagatgggcgctggcagacagcccaggagaggaggaccctgctggaaggcaatgtgggctagtgaagaagtcgggtaggcctagaccagaatcccacctgggtgaccttgggcaagttactagttactaaacttctctttcatggtctaaaacattacatagagctaataatcactattctctaggcttgttttaagtattaaatgagagaaagcaataataatgacggtgaaagtggtggtggtgggtgcgtgctgtgagactgtatccccagatccctgtcttgtagcctggagggcaaacagggactgccttggtagagaggagatccagcagcaaaagcagccagtgctcttacaacaggataaaaggactctctgggccgggcacggtggctcacgcctgtaatcccagcactttgggaggccgaggcatggcctcggtggatcacaaggtcaggagatcgagaccatcttggctaacacagtgaaaccccgtctctactaaaaatacaaaagcaaaattagccgggcatggtggcgggcacctgtagtcccagctactcgggaagctgaggcgggagaatggcgtgaacccaggaggcggagcttacagtgagcctgatcgtgccactgcactcctccagcctgggcgacagagtgagactccgtctcaaaaaaaaaaaaaaaaaaaaaaaggactctctggggacttgaaagaaaatgattatcccagcggcaagtcctaggggcacaggagagagcagaagtgcctctgctgagttctgctggacatggggctcctccctgccaagcatagagggccagttccctggctccccaaaggctccccggtgtcttccctataggccctcccttgcaccaagggcctgctctgcctctggtggatcctctttcctgccattgtccatttatttctagaagtcagatataaagaacaactgccttgttcatcactgtttttactctcatgccaacagactctgggagtgtggaaaagcacacaatatatgttagctttattccaaggagagtaactcagctagtcgttcatccgtcatatctactatcctcccttccttcctcccttcctaacactactccaccctccatttcttctgccttttaatgcagtcatttagtcatctagccagccaattatctacccaacctatcacaacacaatcaagcatccatccacctttccatccatccatccctccctccctccctaagctccgaccgcatgctggagcctatgcttatgggtggagatacacatgtgaaaggcacagtctgtggcccgcaagtagctcacacatagcctgatgtgtggagacagaaaaacaaagaacagcaatctgtttcattgctcacaataggaactaagggaaaacaatttttatatgcatttccgactgtctgtaaccgtcaacatttctaaaacactttctgccttgttttaggcacttccacgctaaattctcacagctcttaccctgtgaccagaaccactagaggccagcctggtggaactgtcctcttgagctcttttttataatgatggagcatcaagcacctgtttcccatgcatggggcctctggtgtcctagctagggccaggaaaggaaggaaaacctggcaggatgacatcagtgggaaacttgagtttgaatctctatttgaccacagcacagctaggtgatctttgacaattacataaactctcagagactccatttcttcatctaaaaaatagagataataatatctaccttggagggattagaccacataccaggtgcccagtagttgctaccattatcttgtataccagatactaatattttattgataatttattttaaattattttattgaaggccttaattgaggctgttcttgcaaaggatgtgatgagataagtagaaatgaactcagagaagatgaattcaaaatcctcgatgggagcatccaagtacttcctggtttctggtgagtatagtgcccttacctgcctgttttctcatctataaagtgggatagccatcatgcctgtgtcttggagttgtcgtgaggttgctatgtgtaaagtgcctagagcagtgcctggcacatgggaggtaccgtatgagggttctcactggggaagctggggggcagggggatccctactctacacagtccttaccaggttccaagtgttttacatgctttatctggttcctcttcatctcattcctgacagataattgatcctttgggtcacacaccttttctctagtcgggcagcacacggttcccaaggagtttccagggaggtacaggcagaacctctctgttggccagtgaggacagggcttgaacagccaaaaggagtcaaatggatagagaagctggcaatctgccttcagcagtaaagtatatggctaaactcgagatattcccatagacagcgcagaacaagtctcctccaggtcctgatgggagaaggccgtgggagaacacaagagcaaattggatctgacagaactggcatttggtagtaaatctaccaggaagtgagcttcctgagagcaggaccttagttagttaatgctcaataaacatttattgagcaaattcaataaacattgactgagtaaatgtacttcaattcctcgattccatatttattgagtgcctaccatgtgtatgtgaataatcatcccttgcctctgtgctcaaactctattgcatataatggggtatttttggaatagaaataggaaaacaattaattatagcccatttcctcagcttacaaccatgagacagtggaatccgggccttgctatttccctattatgtgattttcagcaactggcttaacctttccaagcctcagtatcctgatctgtgaaatgtgcatagtcatcactaccatgtacgactgcgttctgaaggttaaatgctagaaaacactaggaacctgtgtgttagtttctttcccttcatctggataagatacctaactgctctaaattcgcactttcatgggggtgactctctctgctctgtctacctcacagtggttttgcacttgcaatgtcattgcacttgcagtgacacatgtggaaactttttgcaaaccgttttgtgctatagggactgagcgcctattgtgagctaagtactttgctcatcactttatatatattattccagtaattaaagtcaagctgcctgggtttgaatttagcctcaaccacttccttagctatgtcacccactgcacattacttttctgtgcttaaattctttatctgttactggaaatactaatagttttcccaggagtattgcgagaattaaatgagataatgtaacatataaaacaagcctaatatggtacctggcacatagtaagttctccataaaggttagctgttgttagtggctattcctataactcttagtttctagatgaggaaactggggcaaggaataatgaggaatcacttatccaaggtagcagtcaaggatgtgaagcccaagttcttcctgctctgccatgctgcttataccttacatttctatgagcctttcctgtaccttctggaactccctggctgcttggtcatcctcctcttcttaaaggacagacaggttggctctgagcccagcccactgactgagggtgtaagccaggataggcctcctacaacccttgtccactgtttttactctcatgccaacagactttgggagtgtggaaaaacacagtatgtgttagctttattccaaggagagtaactcagctagtcattcatccatcatatctactatcctcccttccttcctcccttcctaacattagccctccctccatttcttctgccctttagtgcagtcatttaatcatctagccagccaattatctacccaaccccagatttgttatggtggcacttacatcagtccctatttctgagccaaaacaggaggaaggccagcacctccatagccagaggttctaggtgctccacaagcagatcccttcctataagggccacacaaacaagactgcttctccagagcacactccaaccacatctcagttacttaaaagttacgggaggggaggggtgcagatgccactcatcagtggagtgctgcagtgaccttaagtcacaagagctactgcgtaacagggctgagcatccatgtctgcctagagcatcaacgaatgaaacacaaagtggatgctcggagagacccagagtgcctcatgcatgtggcctaaaccaggcaatagcatggtggcctgtgtttctaggagttaatgtgcccttccccttcctcaatgtgtccatgtcccttcctcattctccttcagctaagcaatcagacagcccactcaagttaaagttgggctgtttgattacctgactgaaggagaatgaggaaggggcatagacaggcatgtgacatgcagctttggttgctggccccacgagcttgtgctcctgaggggctggcaggcagaaggggtttggtggtgctttggcattcccctgacagcgagctctgaagttggcccttctgaggtgagtggctttgggaacacaggacaacgtactgttggcccaggtcccagagctctcactgaggacccaggggcagtaacagtgctcagtgcgggtatggactaagcatgggctttggggtcaggctgcctgggcccagatcctgggcctgccacttatgagctgtatgaccttggaggaaggtagttaatttctttgtgcctcagtttcctcagctatgaaatgggaatgataatacctaccgtaaggctaattatatgttaaatgagttaatatggtagacgagtatctggcacagggttagctattattattaagtggctttgtgtgcagcggaggtaggggaacaggggaggtggtagctgggtgctggaatgggtgatatgaagaggtgaagtctgcttatgagttcacactgacctgcccctgggggcttctaaaaccctttggaggaggatgggagttgttcaggtggaagctagagccggtgaaaattgggctcttacagctaacatgagcctctttgtaccctcaggtttacaaggcacttcagaggatgctgcactgtctgggtgagtcagcttcctactgtggctgctggtcacagtccaggaactcatctaggcctaggtaagattgcatctggagcctggggccaggtctggggccctacagtaaggcggagatgggctggtatgtgtcctgagcggaggttaggaaggctctgaacactgtcatgggagcaaagactgaagaaactagagaaaaagagactctgagaagactcagaactgcctttctgcatctgtaggatttcaccccactataggttgtatggagggcagaaccgagggagagtcttgggggaggcagattccagcctgaccaggacagagctggccaaccagtgcacaggcttccttgggaggcggtgagcttttcattatagaaatattcctacagattcctaccctgggcccggtggctcacgcctgtaatcccagcactttgggaggccgaggtgggcagatcacttgaggccaggagtttgagaccagcctggccaacacggcgaaaccccatatctactaaaaatacaaaaattagccaggcgtggtggtgcaggcctgtagtcccggctattcgggaggctgaggcacaagaatcatttgaacctgggagacagaggttgcagtgagctgagatcacaccaatgcactccagcctgggtgacaaagcaagactctgtctcaaaaatacaaagatatattcctacagattcctaagacctacctcaagagattccaattcagtaggtcttggatggctgaggaatctggtgttcaaaaaattcccagggtgactgagtggggctcacgttatagagagctttgcctgcctgggcggagcttagatgtgacctgggattcttctagcactggcagtctgtcattctgtggtcccctcaggtcccaggcttgtgttctgacagcttctattcctgctagaaccccttggctacaaactcttccctttgagtctctccctgttcaagggccaatgcagaaaaccccactcaggacatagccttacaaagtgcattgttggggggctttttgtggtatttgattgcagcttctgattaaggacctgaagagtacgtctgtctgtgcatgcctgtgtatctgcgtgtgtgtctgtgtgtgtgtatgcgtgtgtacgtgcagaaagagaaacaggatctagtcctacagattttgtgtttgtgtgtgagaaggcctcggctagtgctcatgccagtgatgggaaataggggctgggacctgaggaatcacaactagggctggaccccggggagctgtaaacttagaaggatgctctgttctttgcctgcttcacagactgggaattcaggcaggattgggacttccagccgagtcatcctggccaaccccgcttccttggctgcctggcctcggatgctcccagggactcaggttccagccccctgaaggctccaggccagctcctgaggcctgaccctcccgaggccgtgactacctgagaaacccaatgtgggtggtctggtgggtgcaatagtgggagaagcactttactcaccatgcctggttgccttctgaaaagctttgaaatgtccagggcgtggcagtaagggaagagggtaaaagaaagttgagtttgatgtggcctttggttgggggggtctgaactgccccagcttcatggtccctcaggctatagaaggcacttgagggctgggctgaacaggcagagtctaggaggcagcaactaacccttgtactgggtaacacataagaaaccagcagcacagcaaagttaacagacttggtctcaaagtttcttggccaagacaaggtctcttgaccagaatgtagaggagctgggattgaagcccagcttggtatgactgcacagtttacattcttaaatcctgtgctaggtatcctccctgataggacctgggcttctcggctcccggctcccctgaattcctgctggccttcctaaccatcacagcttcaaaatgcatataggtacagtgccattaggttggcatgatgaatttctagaggttgccacaatggggggagggttccatgagcttgcctgccacaaagttgagagtaagcgatccctgattggctagtgggagctccaaattccagttccccacaagttcagtctccctgtgaccctgagccagaaccagactcttattaaataacggatggtctctgaaggcccttcaagtgccatgattctctctgtgcccatgggaaatcaagactatagagagaatgtttgcaggtactgatagcttctgcattattggggcccagcagaaggacccatgagggaagaatgcatgagtgaacattatttttacaaatgggtagattcttagtgaatattctcatgttatgattacatttgttttcttacacattacaactctgggaacttaagtaacaaacactttaaaaagaatggccctttggatctccatatcccaaacccatgggatcaagatgttgtagaacttggcagtcttgtgggtggggagatgcccttcccttgaatgtctaagtgacaggtgtctatgttgtcttgttttatgtttcctgaggatatactctgaaagaacttttaattataaagcattgtaagcaggaagaatttaatataaaagcctgtcttcactgacagcaggggtgcatctttgctgatcttttattatcttatattttaggaatgcttttagtcttggggcagctgtttgggggagttgcccaggatttaagagctacattttgcctgagaatctgattcaagggtactaccattgttagtaaagtagaaggggccagggatggccattttcagaggagtccagggcgaggaaatagggatgctaaggagacagaggccaagaaagtcatggcctgagggtctggaagcagtcgcatttgaatgcagttgtgagtgttttgtctctcctttccttaatccccaagcttttggaacttggcaccctcagcagcaggacccactatttcccagaatgggggcctggacttgataaaaccctgggctgggctgcctgaggctgaagggctagggggttggcccactgtcacttagacattcaagggaaggacaaccccctcacccctaaggctgccaagttctgcaacatcttaatccgatgagcttgggatatgcagatacaaagggccattcttttctaagtgtttactatctaagttcccagagtcgtaatgtgtcagaaaacaaatgccatcataacatgaaaatactcactaagaatctgcccttttgtaaaaataatgctccacttatagattcttccctcacttaaaaagcgtctatcccacctggctcaggtcagtttggatgactgtccgatataacaggacaataccatttcaatgcaaatcaactgcaaagttcatgaagtcaaagaaaacagtgatggagaattttacatgcaaggtctttgaccaaggagatcagatagagcttatcaattaagtgaagaaaatacgacgaggatgatgctcaaataggttcttcaaaagggaataatttgaatatcgagggactgaaagagatccttggggaaatggatgaagcccttaagtattaaacagacgtagactcttaattaggtgctgtaaagtaaaatgtgaagagcgagttactatgtgaacagatcactttgctggtataataaataaatatacccacaccaaaatcaacattttattctttcttcaatctgaaaattagcacataacctatattttgtaatctgtatagctaaaaatagcttgttttgaatgcctcatttgtacaataaaaatcttgatgtctctttaaattaatctgctttcatcatttcctttctataataaaatttcactgaaaaccttttttgctatttactatacaattttgatctccattttaagtggattcactttaagtggccttttctcgtgcccactcacctgacataagaggttctcagtgctaatggttctcatataagtccttctccggtttcagagggagcctgcatggtttgtggtttgacttctgaggcctcagtcagacacagcctagatggttggttctatacccagaatatttggggcctcggtcaattcaaaccaactcagagtaattgattcctcagtatggaagccacacaccttctccaggtacccactgcaacctacatgagctgtcagcaaaccctctggccagcctaaaagctgtggcctcagcccagggtgcttggcttggcccccagccaggctagctgagggcagggagggggcacttacttggccggcagggctctgggctgcctgtggctctccggggggctcctcgtcctcgggaatgtggggcatggcagcctcctgctgggagtggccacgtgtgcccggaacctccgctgcgtcagccccaaagatgctccaagaggcctgggctccacaggctggggagatgccaaaaggacaagtcaaatccattcccatccctgtcccaagctgggttccatttcccggagccacaagccacagtgagagccggcttgagtttgcatcaacaccggaggtcaaaccaggctaggagagggcatttggaatttcatttcctccggctctctggctttgtttacaaagtcagaggtgaccttagagattttgcatctaatttggtctttacagtaaacacagctatcccagaagggagaaatgtgcttcgaactcctcaaagctgtagctaatggaagatactccattgagatcacattggcagttgtttaccacttactgagcacctactgggtgccaggccctgtcctaggagcatcaccatcatctgattgaatcctcaagatgacctctgatgtaggcattaatattcccattttacagatgagagaaccgccccagagagtgaaagtcacttgccccaaatcatacagagaaccaataatttgaacccagatcttcctgattttgaggctggggctttttctgctatactacacagtgttcctcagccatgtggatggggagtaagaggtgctgtttcctgacttcctccctgacacctcccctcatgctcttctgaccctcagcacaggctctctcatttgagttcagcccttatggggactacaccagccctactaaaacctgggggctcaggcagggtgaattccatgtgccctgtgcccacccctggcaaccttagattgactcccagaagccaggctatcccttccccatggtgcagcagcctgggggcactggggtcccagtgctgattgggactgcaatcagcataatctcatccacctcccacagtgactggctcagggatagacaatggacccagcctacatcgatgagcttaaagtggtgttctaggaccagatgctttctcctgctctgagtggtggagtgtgaagatatgagacctggtgctacggacactattttgcttccatgaggaaagccagacagaatctaaatgatacacacagaggagggcagagcgaagggacctgcagagaaacagaactggagccctgattaaagtgtgcctgaagcctgaacactttctggactagctggttacatgaacaattaagcctcttggtgttgaaatcactttgtgttgggtttttgttccttgtaactgaaaacatgctccactactctttcgtgcttcttgtctgtcaagatgcctaggagtatgatcctgccaacagacctgagccaatgggtctagctcctctgcttcctcttagaagaggagactagcaatgccaggtttccatagggaaaggcaggatagcaatgtagaaagaacacaggctttggaaccagatatctcggtgtgagtcctcactttgccactcactggctatgtggccttggaaagtaggcttcatctctgagtcccagttttcttgtcaaaacagataagaatgcctcccaagcaggatgctccaaggatgaaacacactcagttcacagtagttcccacagaggccacctgcacgggggtctgcagcccaggaagcttggccgaagctccaagggctctgcctggcctctccccatccttaaactccctccttcttttattagtggggtgggcaataccttcaggaatctatagaactaacaactggcctggttctgcaacttttagagattccctgaaggagctgctccactgcacagtagattaagaccaccatgcagataacatagtgaggtgacctttggctgatgggacatggtgggtgggggtggagatgaaggacactgtcatttactgagcaccaactgtgttccaggtcctctggaaggtactgctgactgctggaggctgtaggaggaagaaccggaaagccctgccacctcccataatacttggtgttcttcctgtccttcagaaagggctcggaaagcccctagagtcagggcactggagaaaaggcctgagctgccatcagcccagctctgacagaccccccagccaacacacatacctctagactcctggactgagctccttgagctaggcaaggtgtcagattcatcctaggtacccaaaagattcagcaaagaatgattgttgatttatgtttaaagaactagggacttttagccccaggattggtcaaggtgaccaccatcttgattgctgtctttctctgcaatgaacaagttagcccacacagctctggaacagttagggtgacccctactggtcacctcaagaaatctcaagtagaccatccatagagtcattcattctttcactgccaaaattttacacctactctaccaggcctgtgcaaggggctggtgacataaagataatcttggccttcaaggaacatagagcccagtggtaggagacgctggagaacagtataatggggtaaatattttgaaagtgagaagttgcaggaccccagaaaagggttacctgtgggaactgggatggtgggacatgattttagcaaatatttcacattacaaatgtttgagctgagccgtgaacacaaatgctgagtggaatttcttggaacagattagctgggtgtctagtggggaagataagacaggatggggagaagccacattggacagacttcacctggctcttgggaatgagaactacggggccagggcatgctgtctgtgtcttccatgccaaattcttactgtatgaataaactgagcatcaggttcacccaaaggtgagctctgtgattaatttctatcatctttacttggatttcagcagcagtggcatcagtggtgctgggtaaagtatttggtaacaggggttgagggtagcaaaagactagccacaaaccctgattctactaaaggaagttggctacatctcataggaaaccttttaaaattatgtgtgacgtatgtacaggtccaggctgtcttaacaggggcatggtttctaaaacatgggaggtgactattccacttttcttttgtcttaatctacacaaagtatattgtgctctgcctgttaagaaggatttagacaaattgggacatgttttgaacctgggaagcaggaagcaaggagaacaaaaatttgtgtttaaagaactagagaactttagcccggagaagaggaagtgcagggagaaataaaaatctcttctcagatgtttggaaagcattcatgtggttttactgttcccaaagaatagatgtcataactaatgactgaaaggtcagatgaaggcaagggacgaccttctagtggttggaaccacctgaagatgaaacaggctgttctttaaggtagtgagtccccattccttggagcgttctcgtaaagcctgggacaagggtcacaggattcctaaccacttcaggggccttttctaaccctgggagtccctgaaatcctggactctttttagctacaacaaactgaaagacctgacgattccatcccaggactctgggattatggtctgaagtctcatgagaaatacctcattttttaaccctctactttcttcctccacctccctctcttccaaaaagagcttaagtcagtccctgtgacagaaagcagaatagaacaaatgagttaagtcagatgtcagctgccacaacataaaagtagagtggatgcttgctgaggccccactcttgacaagatggaaccccaggctcctcaggggagccccagcagccctgcctgcaggggccattcccacgctgctcctgccctgtttgctgtctctcccatccattattataaactcgctgcttaaaatagcaaggtaaaaggagagtccctgccccagggtgacatctgggttctgctggagcttgtgggcacacggacctcacatccatcactgcaaagtttagaatataatctccaggaagtgctgatctagagcaccaacccataaaaggaaaaaatatttagtaatgtttggtctccaagctgttccttctttaacccattttcagggcccttcttgctgcctctccagtctggttcggaaagggttaggtaggccagtgccaagagctaatcagcttttatgactctactcattctgcctccagctagtgcctaactagaacctggcccattttacaggccgggaaactgaggtgcagaaacggaaacaacttgactggttcagctacccttgtatctggtgcaaatcttccaagagactctgctgggataactatccagtaatttgtgcaactgaagaggctagaagttcctaaaccatatttaaatattttatctgcccctgctcatgaaagaaaacaaactaatatgcttttgttcatgctttcattcttcagctacttctaagtcgcctactgagcatcggacactatgctaaatgtatttcaagtgctattttctttaacccccatgagataggttttattatttccatttaatatattaaggatctagggctcagagaggttccgcaacctgctcaagatcacacagctagtaagtagctggtgaagggctataatccaggctagtctgactcctaggcccgccatctttcctctcttccactctggcttcttcaccaggagttctgcttgagtgtggcagaaaagactagcacgggggccctgcctcccaggggagggctggagtgagtactcccagtgaggctaaggatggtgggaggcagaggggaggaaacaggacctacacttcggttgtcgggccggggtcttatgagggctaaagagtggcctacagttgagcctgcatgtcctctggtaggtggtagcagcaggtggaggacgcggaggccggccctgccttgtaggcttcaaaggccttactgtatcccagaaagtatagagccatcatcgggacgcacggttcaggaacagaatttacagagactatctctttcagtgctgtcagcagccctgtgagatggggagagtaagtactattattattaacattaaagttagacccatgttacagatgaggaaacagaggcccagagacttgcccaatgtcatcgctcatgaatggcagtgctgggaattcaccgaatctgggtctgatgctccccttccttgcagggccaagcctgttctcggcaggcagcagcagcctctcatcatggcgccaaagatgcctctcccagagccttgcaacctgcctaggagagaccaaactcctctctgaaaccacagtatcccaggagcacagcccgtaagctaagcggctctcagattctctctgtgaatctttgagcattgagggaagagccaagaagccctttcgggaaaccatgggttaacctagcctccactgacctttctggagtgactcagtattctcagaagggagtttttttgttcttccagctttgaatttttgctttcattttagcagcacaaagaatgtgaaagagattaggttgctattaataccacgggtctatctctagatggacaactgatggggggaattgttgggggtgactgcacgtggagctctcttagcccttctgcaaatccagagggtgatggagggacactgagaactcaccagtcttacccctgcacccatttttaccaatggggaaccgaggcccagaggggcaggcatgtgaccaaggccacatctatgagtgaggggcagagtcagaaaagtccccagagcacccatgccccgagcccggctgcatgtggcagctttctgacttttcattttgacggttttgctcatagtaaagggtaagccattgtgtctgtgctgtgaaagcaggcgtccttcggcagtgactcgtcattgttcttgctctcatgctctcatggtcactctcgcaggagagaggatgctccccacaggagatctgctgaaagtgctgggaggtgcctctgggggtcccctgggcctggccaactgcagagctgggttccgcgactccacaagtgagccggatgggaagcctgccttgggaaagccccatcctgcttcctaaccttggcctgctcacggggctttgttgcttggcagattccgttctaatccttcctctgcctctcccttgctggataaatctcccctggcctcagttccctcatttgaaaatggaggtaatagcacccaccttttagcgttgttgtaacgattaaatcaggaaatacatgcaaggtgctggtacatagagtccactcagtgccctcgccattctccaaacagggcagctgagttctctaagcatgcacagcatcaacaaaaccaagccaaggctcagagagactctggtgttcatcctagtggctcagagctcccagatttgtctcctgcaagtaaaagagactcagtcctggtctttgctgtggacagtcccaggtctgtgctgggcttgccccatgtctgtgctgtgctcagtcccaggtccgtgctgtggtcagtcccaggtctgtgctgtggtcagtcccaggtcagtgctgtggtcagtcccaggtccgtgctgtggtcagtcccaggtccgtgctgtgcttgccccgtgtctgtgctgtgctcagtcctaggtctgtgctgtggttaccccatgtctgtgctgtgctcaccccatgtctgtgccgtgctcagtcctaggtctgtgctgtggttaccccatgtctgtgctgtgctcaccccatgtctgtgctgtgctcagtcccaggtctgtgctatggctgcccaaggtctgtgctgtggctgcccaacgtctgtgctgtgctcagtcccaggtctgtgctgtgcttgccccagatctgtgctgtgcttagtcccaggtctgggctgtgctcagtcccaggttggtctggtttcaaagccccagttctttccactatccctgtactcatgatgactcccccaaaacagaggtttttgttccacaggtgagacatgaggcctagtgtggaatccctcctggaagagagccagccacagtgtctggccaagtaggtatttgtgctgtgctgaacaagtgggtaagtgagtgactgaagggggtacagccaccccccagtgtgtggtggaagccccaggattctctcctgaaagtggatctagattgaagggaattgtgcaggagcaggaatggtgaagggcggagatgcagggagaaagcctcggtggcaacagaaaagggaggatgaggaagtggaagtcacttcccccaagactgtgtcccctaaacaaagtcacgtttcgggaggctggccctgagaaccccgacaatcctggggtttgcacctctgtgggaaaccttcttagggcccgattttctccagccctgctctccgctcctgtggagctcgtataggctttgttggctgggggtgccctgggaaggagccagcacctgctcagaccaatgacaggaaataagcctaaacatctccccaggtttcctttccagcttgttcacttcaggaattctttttttaaaaataggtccacttgaaaaaattttttcttcttcaaaatatgtacaattgctcaatcggaggcagttcaaaggcaccgagaatagcagcaaagtatctgagcctcccatttagcgcctagcagatataaatcttgcccagttctgtttgttccaggctgctcagcagcctcttccctgagtcactcactcaagagtgacatgagtcatcatcctggggtcaaggaccacacggcattctgggtctgtgagatcccataaagggcagggcaccgaggggtctccaggaagacatggaggatcaggaactgtctcctaggccctaggcttggctctgcctccccacatgggtgactttagagagtcactaagcctgagaagtaggtggatttctgggcccttctaacttgtactttggaggaatctctttagtggtgcacaggagcctgcttgttccagctcataagagtctaatgtaattttcaagaattctgtgaactggtggttaaacacagacattattaaaaaataaattacatgaactcacattaaacaaaaaggagataaatactcaaaataactgctttttaattattttactacattttactattatctatgctcttctgaagatttatttctattgtctctgcatagcggaaactatataatgatttgctactgcccatctcttctcagttccatgatcagtgagggtgagttagtagcttgccattggtcatagtgggagtatctataccatggaaattggcaaacactatgtacatatcagggccttttccccccagagagctggccgtggaacattgccagcacaccactgagctactcagccccaggctccctgattcttgctcctaccagggtgcagaaggaacacagatgactttagtatcaccccaagatagcacagttatggagacttcattgccaattgtctttggacaacttttcccaagtggactatgaatcccttatcctcaacacatccctgacagagctcattgtttctttccctccccagcccactcctcctgtgccccagagaatggcactcaagctacaaacctagaagtcaccgtgactccttcatttctgtcaccctccacattcaattagatgactctgagtcccatcaatcctagttcagaaatgcccttcctcccatccctggcacccctgcccatggctctgtgtgacctgagtcactgcaacagcctcatttgtctccttacctctggcctggtcccttccaatgaccctccataatgataccagagcagtctgtctgaaacacaaattggatcatccttccccttcataaactccttgaggattgattcccttttaccatgggggggccagttctgagtcaagctcctagcccctctctcgaggctgatcccctctttcaacctttgtacaccttatgccccaaccacagtggaccaaaagccaacctccaaacatgccctgcttttttacaccctttgcatacatcctcctccttatacttgggctgccttctgtcctccttctatactttatgggttcctacttgtcctccaagacccagttcacatatctcctccttcataaacccattcctcctcttcacctcaggaaaagttactcccttcctgtagtagtttcctactgcgtctgtaccaaatttccacatatttggtggcttaaaactgcacaaattcattatcttacaattcttgaggtcagaagttcaaaatccatctcagcaggctaaagtctaagcatcagcagggctgtgcttcttcaggaggctctaggggagaatccatttcctgccatttccagctttagaggctgcctacattcgttggctggtgacccttttttctccatcctcaaagccagcagagtcgctggcatcttttctcccctctgatctctgcttcccccttcacatttccttctcctctgactttcaccgtcctgcctccttataagaactcatgattacattgaacccgctcagttaatccagggtaatctccatctaagtattcccaatttaatcatatctgcaaaggcccttttgccatttaaggtaacatcttcataggttcctgggttaggatgtagacatcttggggaggggggagtattcagcctactgccctatcctcccagggtactttgcccagaactcaacccaactagaatttgaacatctcaagagcagagactctgccttattcatagctttatgaatattcttataatattcatatttttatgacctgcctccagtacagggtcaaacacagaataggcattcactaaatgtttattgagttaataaatgaatgacaccgtatttctaaaaagcagagaagaaggttttacataggctgggtgcagttgcccatgcctgtaatcccagggctttgggagatcaaggcgggtggatcacttgaagtcaggagttcaagaccagcctggccaacatggtgaaaccccatctctactaaaaatacaaaacttagccatcatctgggttgctatataagcaagtgggtggccttgcctgccctcattctcattgagcttccccaggttaatggccaagtttttctctctctcgatgatgtacccgggtttcatgtcttctctgccacacagatgtgcaaatttctcccatagtattctacaactaaaacctcacaaaaggccagggcctccttctctgacaccttcatgcttctgttctgccatccaggagtaatttgcaaagtgaattttcagattaacttatcaatggctcttctagctttaacctaagcctaacagaagaccacagagcagccccaccagcccctctggctccgcttggaatgctgaccaaagcatttcctcaaacagttggttatgtgtgttcaaatgcggcagcaccctcgtgtctgctgctgtggtactctggaaccacctccttcctgacagagcagagccgggaggctttgcaaggtggtcattgcctttaaacccagacctggactcatggcttgattcctgctccagcaaaggcacagactctggtattaggggtcctggcaatccagcacctgggattgcccattcccatgaagcaggcctctgggaaatgtaccttatttcaggtagaaggcaggaggcactgtacccacttgatgggatcgcactaggccttgatggccttggttctttcagaagccaacatgtgggctgaatctgagccaacggcctcttccttggatctcccggcctctgaacctgaagatgcccttttcttaggatgggagcaaggatggataaaggcaagctggtgttttgtccaggcccagagatctgtcaagggccatctagaccaccaggaaccagaagaggcaccctattgccttggattctttagaaactttgttccaaataaaaataaagcttccttgacttggcaacaccacagcccaataaataaataaataagcaaaaaaagaaaagaaaattaacacccagttcccagtgtgcctctctcattcagttcctcctacttctccatcatctccccttcccttcctagttttcttctaggaagaggtcatcagggtctattaggaacctgtaggaatacatataggaatataggaatatatgtaggaactggtttgggaaagtcagaaggaaaagatggcctccatggtgcctgcctaaatcattcacccattctagaaaagcttgttgagtgcttcctatgtgttaggtactgtgctgggcactggggctctggggtgtgtcctccaaggccacctcctccaggaaggcttccctgacctctcctggaagctatattctcctctggtctatgacagcactgtgtggctatcccaatctgccaagcagtggtttctgtttctcatttgcaaagcctgagggcagatagctttcttttgtaacacaggtacagagaaagttctcaatacctggtggatctcttcttttgaaagcaaggactctaggaatcaagcctcacttttcacatggcctactacacacccagcacaatgtagatacgctagctcttgaaccatctcaggtctgtgagaaaggaattacttgtccattttacagatgaggaaatggagccttagacaagcaaagtgactcgctctaggtcacacagtcagaaggcagagtcaggattaaacactgggtctcctctgcccaaaatgggatgtttggctcttccttagagagagcttattcctatgcttctctaatcttagcaaagacagaacaagggtattaggagatgttttttgatagggcagtgctcttgatcattctagatcccagctcttcctcagggccagcacagccaacaagaacaacagcagccgagacgcagcccctctccgaggaactggaagtccttctcacggcatcccctggggtagacaggaagcagctgcgactgtgatcatctaagaccagcaggagagagtgttcttccctgctgggatggagcaccccagctcaggtccccgcctcctgttcatctccactctgggaatcccagttctccaaagccatggaaataggcccaataaccttgggctgggctgctgggcaaagtctggtgtaaagcatgctacagaaagctacagcaggattgagataggggttcagggacagggccttgtggggagtgaagagcagactgccatgctaactgcctgtgtaggaatgagttccttcaccattcaggcctcagtctctccatctcaatagtaaaggctgggctaacttgccagcctgagccctgctttctgccccatgagttcaagttcacgttgcctattgaaagcagtcacacagtaggaagttaggggccttcctggcatcccagggctggaagcagccatcacatccccctgatcacagtgattggctggagggtgagcatgtgagctgacaagaaccaatgagatgcaagaagacattactgggcatcctgggaaagccatccttaactgcagccttgagttccagagggtgaaagcagaatccctcttaagatgatgaagaagaacttgtctaaggatggaatcaatgtgagacagagcacagctaagagccagaaagaaactaggtcctgaggctatcttctcagatcctgatcaagccatgcctgatatccccagccttttctgttttgagaaccaatgaataccccttttttcttaagctggcttgtacgagcttttttggcacttgcaataaagagttccaactggtgcaaacagcctatcctttataatgctgcctgtggggactttcttggcaccaagtcttctctcacctctctactgtgctgcttacctaaccctaaccctaaccctaaccctgagagtttaagctgggaactcagatctagagttgatgagcttaccctaagttattccctaacttagaatatcaccatgcccttttcctcagaacctgttcctctttctgcattccctgctaccattggtgggcccagcatctggccagaaaccccagcccaaacacagaaccttctcccacctctccaggatgcctgtccccacttctttttactaatacacacatctaaactgttagggctccagaggagtgactcggtttgaccaacctccatgttcctgcctagacgatagactggtacacaccaagatatgtttgttgagtcaaatttcaaccttcaaatgattttcaaacatcattacttcctgggggcgaccactccacctacctatccctcagctcagagctggataggctctcactctcaaccctccccagaagagcagaccccaagaccgggacaatgattggctgtgtgaacaggctcgcagccctgtgcttggaaccccagcaccagagtttagggtggagactcccatgtgcaggacaggaaggaagctcacaccttgccgactgaggccagcagcagggtgggagcagctgtggatcttggccagggtctttttttcaccaatagactctgagctgaactgcaggatggtgggtgtgtacacaagaagacacgtgataaagtaaaagtgagcagtcccttggttatccagatgtatgcaaacagctgcattagctgagtctttagacccaagttgagaacaggttatggtgaacagtgatatgcaatggcaggggtgggtggaagccgggagggtagagcctgggaatggctctcccaacagcaagctttggtgattagaggcccatgtatttcaaggtcctactgcttaaatgggcatgtgcaactgtgactgcctaatgatatgagattggaagtaaccatagagaatttctccgcaggggagtcatttttccaccatggagaggtggggatggtctgggagtaattctgaggcattagcaggagagaaactgacatttattgtaccaggtgctctacctgactctttacatcctttatcttatccagtccttacaacagccctgcatggtacgattattcccatcttacaggtgagaaaattgaagctcagaaaggtgaagtaatttgtttcagacatcacaattactaagtaatgttaacagggtttgagctcaggggagcctgactccaagcccagggttctgctcagtataccataatgaaggcttctaggtcaatacagagccaggcgacagcagcagcaacaacttcaaccaaaaatgaaatgctaacacaggaccagaagaggtttttctggctaaggcttcaccagtttgtcatcgtggagaaggtatcatccctaacaatcagatttacctatgttctttgttaacctgcagtttgttatacatgcaatagctctgcttaagttaactggtaaatagcatagagtttatccaacgggttaagctgagtcattctcgtgaagtattttcttgtttttagaaaagactgagtaaagagagctctgagggcaggttaaggccagggactgcctggagatgcctcagcagttttgctggagctgttctgggctgtgagtgggcaggcaggtgagcagacccccttcctggcccaggttccacaaggagcataggcactgggaaatcactgggttttggcagggttttcttggatcacactagcaacattaccaaggcctgagtggagctcctgcaccctggggaacattttcccagggtagcccccaggctccttaggtcggctcagacacccctctttcctgtgcccacagttggtatttcctagttataaaatgattttttcattaatgctatgatagaatgtagaggaatgtagatatttttaatatgacaacatatgtttatagaacagaagttttttttttcgtttttttgtttttgtttttaaagcacctaatttggagtcaccctggatcccagaagccccaaagtcctgggacattgttctcgtggcctttcatctcttttcctctgatcttctggatcccctacacagggcccttcctctagggttggcagagtttgggaaaagcaaaggccttctagggccctgggctggaatgctggctggggtatggctggcaggctttgtggttgggactggttgggagcagcagctctgctctgctcagcctgcaggtcagcactggaaggcccaagttgggcaggggccccaggacaggagggagggagccgctactcaatgctttcctgatatcctcttactgcctcagttacctcccaattccctactcataaaaatctagccatcctgcagccctattcattctacatgtccagatgagaaaagctgataaccagaaaatcgactcctggggtaggtggagggtggttctcctatgaagtaatccatcttccacacagctggaattctaaaacataggtgtggtcgcaggcctccctcaagtcaaacatttcaatggctttctgtgtgctgactcccaagtctggctgcttactaaaagcacctgaggtgcttgataaaatgaagattcctacacccttctcagatagactgactcagaatatctgggaatagggcctgggaatctgtatggctaaaagcccctaaaggggaatctgatccaaagaccagagctggagaagccctcgtccacagatgaagtccagtttcctgggcactcatgcaaaactttctgctctgagactgccaaacctctctgttttttctccagccactaacaccaaggtatcctgcaccccagcctcacctaatgctcactttccagaatattccacgtgctatcaaacctcagtgtcactccctctgcctagaaggccatccccccatctgtctccatgaaagaccctactcatccttcaggagccaccacatgattctcaccagattaaaccctctgccccatttccttttagcattttaaattgtttagttggaaacatagactttaaccttctatttgccactttctagctctatgactttggctgttgactttcaatgtcctcacaaattattatgaaaaatattcaaatttgaaaagtatgtaaatgtatgtaaattagatatacagtgtctagcacaaaataactaacagaatggtaacttttattattattattcctatattatgatggcattcctctaacacagagttcaacaaactatggcctttgggccaaatctgaccaactaatggtttttgtaaataaatttttatcaaaatacagcacaaccattcatttgtatattgtctatggctgttttcatgctatgagggcaattgagtagttgaggcagacactctgacttataaagccgaaatatgtactagctgccttttttcagaaaagttagccaaccctgctctaacataattgcaattatttttttatagtttcgtctcccctatttggctgagagacactcaaggatcttcatggcagactcctgttcatccttttaaactaagtctttctcatctttgtatctctaacatttggtatataattagggcttggtatatgttaaattgaagtgaataattctttaacccagtttaaatgcacacatctcctgaaagccctgatgggaagatggggtaagtgccagcagacctggctctgaggctgcctccctcctggcttcagcatcccacagtctcactgcctcccaccacccaaaacccagcactctgtgctttgcagctgtaatatttcccctgatagagaggggaggaagaagtccttcaaaggttagtatattcccattatccaagagtgtacaaatggatggtctaatggtccccatggtccttacagggggcaatttggtggacccatttttaataaataaactaatggattggtattttttctctggagatctatattttgtttagtttcaactacccatgaatttgcattcctgacaaaagctccttttgagaagagaactaggatttccaagcagtgagaccatttctttgtgagctgtttatgaaactactctgtgaccttgggccagtcacccgcctctctgggcctagctttcagtttctgtataacaacttccagacttgactccctggagttctagccagagggatgaaccaactcatggtgagtgaaaacagtggcctggcaacaggcagcttgacagagtgtcttccctcttccatgctgcagtagcacattccctgtcctccccagcaaatacagcgactcatttctactgccttttcttgaggcttaaggaagatactttagccctaaagtagatcttcagaagataagaaaatgccatggtgtggaaaactctgtgctggatgaagtggaaacactcagctctcccccgaggccagatgaaaagcacatggatgaaagccaaagtccatcccttccttgagcctttgggagcagcagtccaccctctctttcagaaagtagttcccccccttacccttcaccctccttgcagacacccccatgggataaaatactgagcctgcaggatcctggttatctgggggcaaatcggtgtaactgtggattgaactgacttttattgatttcccagcaggtgatttataactgcctgcttcctaaaagggcttgtggccagatggcaataaaaacactcagaggccaagagagttaaaaataaatgctgaaaaagagagcagaggaaagagggagatagacagctgcactaaccgaggtgggatgactgctcagtctggatcacagggatgggaatcttgcttttcagttcctactgacataaccaattgagatcagcagcaccttgtttttggcttttgcaagaattgcagagcaaggagtagctacatcttgagcttccaaaactaacccttagtccaacagagaacaaaattgagtgagattttgcattttagaactttataaagctcacttcacagagggactcctcatacaactatgtcaccgtactgtttacacaacaggatctggaagtactttaaagccggcagtgtaaatcaaattctaggtgttatgtacatgtctgagtctaatggctggtcatccaccctccttgacttggctttagagtagtccttaactaaaacgagttctagggtcatgcaaaaccatgcacaaggatcctttagcttagtgaaaataggcagtgctttctaattctggccataggtcactgtcatttggtggtcacggtgaattggttatttaacaaattctgttttcactagttgcaactaaccagaaatcagatctctcaaaggaaaaccaagaaggctattgctatgggcttaattgtgccccccaatactcctcctagttcttatgtcaaaatcctaacccccagtacataataatgtgactgtatttggagacagggcctttaaagaggtgattaagtttaaatgaggccattagaatagaccctaatccaatctgactggtgtccttataagaagaggaaatttggatgtagaggcaccaaggatgtgcctatacagaagaaagaccatatgaggacacagagagaaggtggccatctataagcaaggagagaggccgcagaagaaaccagacctgctgataccttgatctgggacttccttagaactgttagaaaataaatttccattgtttaagccacctggcttgtgatattttaatacagtagctctgacaatctaatatagctattgatagaatctctcagccatatcagatttaaattcaagtctgtttcaaacatttaatctttgaaatagggatcaatacattttggagaataattgctttagtatttttccaggctaaccacaaaactcctttcagaacctttctaatgaaataaaaattctctagactaggtcccaagaattctacctttgaagaagtaaaattatctctatttgcaggtgatatgatcttatatatgcaaaatcctgaggaatccactaaaaaactattaggactaataaatgagctcagcaaggctgcaggatatatgattgatatagtacaatcaattatatttctatacattagcaatgaacaatcaaaaaatgaaattaataaagcaattctattcacaatagcatcaaaagcataaatacttaggaatacacccaacggctggccgggtgtggtagctcacacctgtaataccacaactttgggaggctgaggtgggtggatcacctgaggccaggagtttgagaccagcttggccatgatggcaaaacctcatctaaactaaaaatacaaaaattagcagggcatggtggcgcgcacctgtagtcccagctactcaggaggctgaggcatgagaatcgcttgaacccaggaggtggaggtttcagtgagccaagatcacaccactgcactccagcctgggtgacagggtgagactctgtcttaaaaacaacaacaacaaacacaacaacaacaacaacaacaaaaaccagaaatatacttaacaaaataaatgtaaaacttttactctgagagatatgaaatatatttgaaagaaattaaagccctaaattgttggaatgccatctcattccaatttcatatggaaacacaaggaagcaacaataatcaaaacaaactaaaaagaagaaaaaaattatctacacatcccaattgcaaaacttactataaaactatcgtaatatagtatgatactatacactatacaagaagagacatacacatcaatgcaacagacttgagagttcatacataagcccttacatttatagttaattgatttcaacaaggatgccaagacaattcgatggggaaagaagtcttttcaacaaatggttctggaacaacgggataaccacatgtaaaagaataaagttggacctcttcctataccatacacaaaaattaactcaaaacatctaaatgggagagctataactatagaattcttaggtgaaagcatgtgagtaaatcttggtgtccttggtttagacaatgccttcttagatacaacaccataaatgcaggcaacaaaagaaaaagtaaataaattggacttcatcgcgatacaaaaaattctgtattgaaagtgatgctatcaaggaagtaaaatgacaacccacagaatagaaaaaaatttgcaaatagcatatctaataaaggacttgaataaagaactcttataatgataaaaagacaagtaatacaatttttaaatgggcaaaatatttgaatacacatgtctccaaagaatatatgccaatgaccaataagcacatgaacagatgttcaacgtcatcaactatcagggaaatacaaattaaaacagcaataaggtaccactttacacccatgagggtggttaaaataaaaaagacaacagcaagtgtcgactaggatgtgaagaaactagaacccttatatattgctggtagaaatgtaaaatggcgtaaccgctttggaaaacagcttagcagttcctcaaaaggttgaacataggattactgcatgatctaccaattcttctagatatgtacccaagagaaatgaaaatgtatatccacataaaaacatgtacacaatgttcatagcagcactatttataatagccaaaacatggaaataaactaaatgtccataaggtaattaatggatgaataaaatgtggtatattcatacaatagaatctattcggtcataaaaaggaatgaagagccaggcgcggtggctcacacttgtaatcccagcactttgggaggctgagacgggcgaatcacttgaggtcaggagtttgagacaagcctggccaacatggtaaaatcccgtctctactaaaaatacaaaaattagctgggcttggtgccgtgcgcctgtaattccagctactcaggaggctgaggcatgagaattgctttaacccaggaggcgaaggttgcagtgagctgagatcatgccacttgcactccagcctgggtgacggagtgaaactttgtctcaaaaaaaaggaatgaagtaatgatataagttttaagtttcatgctaaagtatgaaacttaaaatgaatgaaaggatgaacttgaaaatattatggtaagtgaaagaagccagtcacaaaaaaccatacgtattattttatttatataaaatgcccataatagagaaagctatagagatggaaggtaaattaatggttgcttagggctgagaggatggggaaatgggacgtggctgttaataagtgtggggtttctttttggatgataaaaatattctggaattagttagccatgatggctgcacaactctctgaatatactaaaatccactgaattgtacactttaagtaggtgagtcatatggcgtgtggattatattttaacaaagctgtttaaaattttttctaacttccattaaaaaaaaaagagaaggaagctagctttggtccttagtgccttgtgacctctctgggcatagcttcctcaaacataaacattagaaattaagctcgatgatttataacgtgccttccatctctgaaattgctgaggatacataatgtaagaaaacaggttgagggaaagagatagattatgtgtctaggatgggctcgtgtgaggagaaatgaaggaggaggcaacaataagaagactaagagaaatagagatgaagggacagggacacgggctcagagagacagacagagacatggagacaagactacaccccaaaagaaagacagactcactgggatgaatgtgcagattactcatctgttcttccatttaacaaatatttacagagcgcctaccaagtgccaagctctgtgcagtagtaaaccaggtagaccagggcactgagctcagaggtaagagacatagcagtaagcaggcaatttgcaagcaagcacagagagcgagagctgggatgcagtaattcaagatgctccagaagtgcacagatgcaacatacaccccacaccacactccacatgcacaaatgtcccaaaggtagactcatttttgtagggagcgccattcctcatctgaggcatttagagttctgctagcaaagacattcaaataaacgggtttttacaagtatgggcacaaatgggggtgacacctttcagttctcaccctgaagtctctataaaatgaggctgaaggacaggattcatccctcactccagagcttcccagtactctttccccctcatcgggagggactggctttggaaacagagaggaatgtgacctattacagccacaccagcaccactcctctgggctttcagctggaaacttcccagaacacattttgttccaccctccttccatcccatccagacctggcgacctggcccaatgaaggcatcacatgttgccccttcccctgtcttgtggcttctctgctgctgacaggcacatgaaagggaattgaagctcaacagaaaagtgactgcttcctgcacggtgtcggctccctgcctgactcagattcagccaactctgaggagggaaggcaagggacgtttctggatatctcttgcccgggtccctcttctcctaactccagatttagcgagagtccaagctacacaatattcctgaaatagccccaagtcacatcctaagatgggggttcatcccctcatatgaaggattctctttggagaagatgttgggggctttggacgccgtgcactggcacacgaataggaaacgcagagtgacccggagcaggaaggaatgggcaccgccctgcagattctgggcaggctgcaccagtgctgggctgggaaacagcccctgggctccctgaagatctccctggctgtgcaccatttggagcagcagtgaattaatgtgattcaggctccaaaaatagtagccagagcatctaaaattgctttccaccctggactgggccagtcccctgggaatgtcagcatttctaaaatgtccccattcacccagagtgcctttgtcagaccccaagtagaatctgggccaccgttaagctctcctggttccgttggctcctgcccggttcccctctcctgtgtgtcacgtgcactgcctcccaaacaggaaatgctaattcatgcctgccacttgctgttaccaggtccaagaactttaaccctgcaaatggcttggaagggcagaaatggtcccttgcagaagtggcctgggtggctctctatcactgagttgggatttaattcctaacaatgacgactggggaagcaggtcacctgaggaaccctgagcctctggtctgctgctgatgccaaagggagtcatttccacagtggcttgtctttctctgacaaaattatttggggatctcagggaatttcatcatcatgaagacttgtcactctaggcctacctcagtgcttttgcacatcctgtactctacgcaggaaacaccatttacgccctcttccctgactgacaaatgccccttcatcctcttattcagcgccttcctaagagtgctgcggtctttactaagtttgtctgcaatgaatgctctggaatggccacctttgcccaggttacactcccatgcctagagattcacaccctgcattctcctacccactgatcgaccacgactctcagctgccttattcatggacaggagtgaggcaaggaacaagcctctcccctgcctcatggaggctggcctcccatctaacaattaaatggccagagtctgtaaccactgcatggggttcctgatttaaatgcagtttgggaatctctctgcctagagaatcgtgatttgatctttgtgatcatgtcctttagttctcaggttcttagctgtgatgctcgtactgcctcttagtggcttcgctttgcctccctaagagattccagaagcgcaggacacagaaagtgatggaggagtgaggagggagaatgagttagtctacaccttggtttctccctgtgcggtgggagctaacggtttctccgtcagaatggttgagaggatggcatgagatgcgtacatgactcagcacagtcagtgctttggggggcagctgcattttcgcccatgcggtccccagtcccccttcttctggcgacagcagcacatccatcatacttgtgcttgggatgggggtggttgaccccactgtgggattggagctatgacactggactggccccacagaatatcccatgctcccagctctgggttgtaattgaggaatgagcacgtgactcagaccaggccaatacattcagttcggtgacttctgttggaactgttgggggagttcctgctgcaagcgttgctgaaaggagaggctgggaactgcaggtgccacagtgccaccacacaggagaggtcacctgagaatacatctaatgccaaggacagctgagagacaaggggatgagaccgtggatccagccatgtccgagattgccctagaactctcaatgatatgatccagaacattctgctaatttgctaatctaatttgaatccgtttctattctaggcaaaccagaatcctggcaaatgccaagctcaatatgtttggaggttcacccttcccacggccattgctctggggcgagcggtgttccttggcctctgcagagacgatgccacagctcatctccctgtcctcagtctctcgttcttcagtcttttactgcactgactgttctcaaacacaggcttagaagatgccttgactccccactgcctggagatcatgtcccaacttcctcagatccacctgcaaagctctacatctgactctaatttcctttgtgcgtctctcccatgaccttcccctctgggtccatgcatactctgtgccccacccatattaacctcttccccactctgaaacgctccctccactctcccaaccctgtacttttcctgggaagttcctcacttctttcttacctacctgccagatccacaactaccttctcttctgagaagtcttcatggatggccccagactgagtcaatgtctccttctcctgaatcaatgtctcccttgtacatactgtagtacctcttggtgtttatgacttgagagtaatttatacattttttttgagagcagggagcatgtcttactcctttcaggatcccctgggatccttacacaagatttgctcactctagaccctccctgaatttgctgacacaagaccttggcttccagctgacaaactctgactaccccgtcccctcccctcaaccatactctaggagaggggtgcctaaactttgggtcacatttcctcttcaccagtaaacttcttttttaaaaaattatgataaaatatgtgtgacatatgatgtatcattttaaccattttgaagtgtacaattcagtggcattaagcacattcacaatgctgtgcacctatcacccctacctagttccagaactttttcatcatcccaaatggaaactctgtacccagtaagcagtcactccctgttcctcctttctggcaggccctgccaaccacgaatctgctttctgtccctgtggctttaaccggttctggatagttatatgaatgcaaccatacaatatgtgacattttcggtctagcttctttcacttagataatgtttttgaggtttatccacatggtagcatgtatccatacttcattcctttttatggctgaataatattccatcattatctatctctctatctgtctatctatctatctatctatcatctatctgtctatccatcccacattttgtttattcattcatcaggtgatagacattcgtgttgtttcctccttttggctattgtgaatagtgctgttacactgtgatacaacttctgtttgaacacctgttttcaattcttttgcatatagacctaggactggaattaatgggtcatatggaaattttacatttactgggaagctgcttatccttgctttctccaagcctcaacaacatgctgggtctatttaactgctttcacgctgagagagcccaaggttcttagaagggagcgatttcatcttgtcgtctcctgatggcaatccctaaaggatgttcctagtttttaatactgccctcttgctgtttagagctttcctttgtctaagctatttcagacatattatttaatttattcctcacagaaatactgtaaggaggaaacgattacgtctgctttttgatgtggaggctgacagattcagaggatgaagtgatgcggcaaggtcacacagccattaggagcccagctgagactgaccccagcccagtgccctttccacgccaccacagcggccctctctcaatttgcctctcttttcaaagtctttgtaaaatagccaccatctgaaatgtattctcagacccaccattgtttagaaatgccctcttggtaggcaactggttgatgctggcatggacctctgcaaacactctaccagttggcacctcatttgtaatcgaagctttttcctggggcagattctgcctgtaccaaacagaccaatgtttaccttttctgggtcttctgtcaccttctgcaatcctgggttaatgttcccttttgatgctgctatgagtctaaatctgagtgtgtcccacaagctcaacctcagctctctaaatttcctccctgttcttttgttcaacccaaggtcaacccaagagcttccccttccctttctcaggaagaaactatcccttggaccaaggggtcccctgacctctttggagtagaaaagaggcacaatgcccttcagcctgacatggtgaagttgtgtctatactgctccttggaagcttccaatcttagtgtcctagttctacatgagaccaggagactgtagaaataagcaaaacaggcaatgataacaataacaacattctctatccatcagaagcatagagctttttaaaagcatacgattcagtggcattaggtacattcgcaatgttgtgcacctaccacccttatctagttccagaacactttcatcatcccaaatggaaactctgtaccaatgaagcagtcactccctgttccccttccccccaggccctggcaaccacagatctggtgcctggtgctttaggcatatttactcactcaatcccccaactgccctatgaggtggatgccactttgcagataaggaaactgaagttcaatgtgatgctgtgacctccagagtcacagagctaatgggtggccaaacagggattgaagccgtcagagcccatggcttccccattccagcccactgtctgcctctcaggcagaaggtttgtgagctgaccttgctcactgagagctttccttagcagttctgcaagcagcaaggactctctagatgccacgtgatccatcctgtgtccacccaagtaggaataccactaaccacttatcccaaagttgtatagagttctgtacaactccagatctgggtgatgttgtcaggagctctgaaaagaaagcttatgtgtttcactctatttgggaatatcagcgggagataggtttctgtcttgcaggacatctcagagcctttaaaagtaaatgtgcagtataaatctgcaagaaggggtgaaaggatataatgtttcccaaatttatttgaccatgaaacgtttttccaaggagtatctcaaagtgtcctctttaaaactccactctgggccaggcacagtggctcgcacctctaatcccaacactttgggaggctcaggcaggtagatcacctgaggtcaggggtttgagactggcctggccaacatggtgaaacctgtctctactaaaaatacaaaaattggccaggcatggtggcgcatgcctgtaatcccagctacttgggaggctgaagtaggagaatcgcttgaacccaggaggtggaggttgcagtgagcagagattacaccactacactccagtctgggcaacaagaatgaaactgaggaaagaaagaaagaaaaagagagagagagagagagggagggagggagggaggggggaaggaaggaaggaaggaaggaaagaaagaaagaaagaaagaaagaaggaaggaaggaaggaaggaaggaaggaaggaaggaaagaaagggaaagaaagaaagagagggaaggaaggaaagaaagggaaagagaaagaaggaaggaaggaaggagaggaagggagggagaaagagagagaaagggaaaaagaaaggaagaaaggaaggaaggaaggggaaggggaaggggaaggggaaggggaagggaaatctccattcagaaatgccctaaaccctcttaggttagagggtgtccagaggtgagagaggacagtaattatgtccattggccctggagctgggctgcccgggttcatatcccagccctgccatgtgaccttgggcaagctgtttcatctttctatgcctcagtttcctcacttgtaaaacatggataataacaatcttgtgaattatgtaatataaacttcttagaacaatgccttttgtgacatagggctcacaaacattctaataaggtccttggggccgggcgggttagagggggcagtgagagggattatgttacctataatgcataaaactgtaaaactccagataattcatgaaagattacacagatagcatggtttcattgtcctcagggagggtcagtgagttccagtgggaggagaaagtgctatgcagatggtagttagctgcttgatccatcttcctgggtcttttcaagttcaccaggtctcctctacttagggagtgcccgacacctcctggaggcccctcaaattctggtgcctatgagtttcaccacttccaaggaacagaaatcttgtccttttgtcaccacccactactcctgtagggcatactcatctgcccccagagctggagtgctgggagaagctggccctgtagtgtgagggcagagtggccaggctctagcggctgcctggaccatcatttccaatctgagcagtaaatgtctaacgcatgagtcaagtgccttgttaataaaaaagagaataaataggcattccctttagcagtaaatgttttttttaaaaatacaaccttccattaactttggacctgatgcccattctaactgtcaccaaaggacttgaatgggattgtagaaaataaacaataacagctgactcttcaaacacacctgcagtcctcctccttgtcactgacagtgcccagctgtcaattattgctctgagatgggctctatcatgcaactattgggatgaatcactgggccctgtagggtgaatggttcacagatgaggaaaatgaggacttggaaagaagatttgatttgctcaagagcacaacatgagttgaaggcagaaccaggcctacaactcaggaccactgcttatacggtctcttcatttcagcttaggaagtggcaccagggacggatgctggaagaccttgactgcccttaaacctgagaggtttcattcatgcatgcatttgttcattcatttaatgtatctaccaaatacctgctacaaactgccatggtgctagcttcccttaatacctttctataaaaccataatgatctaaccctttttgaaatcttattgtcccagctctactctctcccggcctgaaaaactccaagtatgagtttctatctgttgatgggctgcatgcactttgcaccaagggcaatatggccttggctctgccactttctagctgtgtaatcctgagtgaactactcagcctcacaaagtctccattttctcatcagtaacatagagataatattataacctgtatcacaggatgctgcaaaaatatgagataatgtatgtaaagaacttaacatagtatttagctggtgctcaataaatgacagtaatttacagacagaaatgacagaaagttacagtaataagcacattattattactcttgtcatgtgaaacaagtctctggagattcagcaaatggaatcttcccctctgggactctaaaaagtcaggctctctttgttcatgtgcctaagcaacttttgtgctttataaactataggaatcgtgatatagggacaacttgccaaatgttttcaggtctaatgcaacagatccttgatgtctataaccaaccgtatctttttttcctttctgggaccagctggcctgagaaatagtcttcctctaagtctgataaggtctgtgaaccccagacctgttaggaatgttggctatacatggagataactgcaaggaaatggggctgccctccaatgtattaacaaggtttaaaaaaacccataaacaatggacatggttagttatctatggaagtaacccaagaaattctctgtatatggggttgcagagttgagaggcttaacagacatctctagaaggcaggacagaaagacaactataaataagtgggtgatgacattctttgaagacacttttactttaagcaattttcccttctttagtaagaacccctatatatgagggatggcttccccatgaccacatttataccccacaatcctgtcccctggccatgactgattgaccctgatccaagctggacttatcagattatttctttcaagaacttagagaccaggagcttctggaacctagtcatactgggcctgtggcctgggcagtgatcttcagagtagagtatgtcatccagggaatgcaggatgacttggtggagtataggaaggaaatttaaaataaaaaccttcaatttttaattaaaaatagtaacaaagtacacttccttaatatttaataaacagattggcagtggtgctggttcatgtattgaaaggccagttatatccagtttgtgagctgttgtatggggaattctacagtgttacggaactgatgtagcaccctcatgtatccatttgtttttcctgaagggtgacacagtttgtgtgtgcccaagtaagtaggttaataaaacatatttatctagttttaaccaaacctactatcataaaatgtgtatgcggcttaaaaggtttgtgccaaaaaaaaaaaaaaagtacaatgaaaatacttctactaataaagctaacagtaattctcaaaaaaaaattttacaaagtagtggataaaactgaaaatttaatataataattcaggaagtaaggatgtccctcttccacatgaggtatctgagctggttttcctctgccctccttccctttctccctgccctgccccctggttctctgctgtgtgcttcaggatgacacctatggaatgtataacttgggctcctttgcttgcaggctgagtttggccaagggaccagtaggggatgggaggagagagaggcctgggcctttcctcccttgctccagcaccacatctctggcagtgactgtgactctccttagctacagctcattctggatggaacctcttccctggctccagagctcactagcttctggtaatacgattttcttctctttccccttgaagaagcacatagaatcatgaccaaagaatacttatttagggaaagcaggaaaattgttgacactttaaaaaaaaaaaaaaaagcatgattttcaaaatattatttcatctttcttgttctttaaaaatttctatttttatgttttataaagtaacgcattagtacaatagctcatgaatatgatttataataaagaaatatacataaattggaggtgcatgctaaaaaaattttctctaaactaataagatgcaacatccaaaaaacttgaagacctctcctgtagagaaaaggctggcaaactataaatcatgctgctataaagacacatgcatacgtatgtttattgcggcactattcacaatagcaaagacttggaatcaacccaaatgtccaacaatgatagactggattaagaaaatgtggcacatatacaccatggaatactatgcagccttaaaaaatgatgagttcatgtcctttgtagggacatggatgaaactggaaatcatcattctcagtaaactattgcaaggacaaaaaaccaaacactgcatcttctcactcatagatgggaattgaacaatgagaacacatggacacaggaaggggaacatcacactctggggactgttgtggggtggggagagcggggagggagagcattaggagatatacctaatgctaaatgacgagttaatgggtgcagcacaccagcatggcacatgtatacatatgtaactaacctgcatattgtacacatgtaccctaaaacttaaagtataataataataataataataataataataataataataataataaagagaaaaggctggcaagttcctgctgctgggatctgaaagctgccctgggtcctgccttcctgaggcattgctggctacctaccttttcctttgattttctcaaataccttataataaatcctactttctcttaagttagccaacatagccttctgagatctggcaatcaaagaactttaaccaatatataggtgggatctgcaatttcttgtgtgctgggacagactatgtgaatatcacataataactaccattttatagagcatttttctacagcaaagagaaaggcttgtccaaacttcccagaggaaagaggcccttcctgagctctggaagagtctctctgctgtaggcagaggtggctcatcaggccacatcatagcttaggtgacccacccctcagaactttctgccttcttacctaaatctctatctatcaagcattttggtcattggaaagggtttgtctcctatcatatactggcacatagacattcagaattgcatacttggctgggtgcagtggcttacacctgtaatcccagcactttgaaaggaggctgaggcaggtggatcacttgaggttaggagttcgagaccagaatggccaacatggtgaaaccctgtctctactaaaaatgcaaaaaattatctgggcatggtggcgcatgcctgtaatcccagctacttgggaggcagaggttgcagtgagccgagatcgcaccactgtacttcagcgtgggtgatgcagcaagattccgttcccaaaaaaaaaaaaaaagaattaaaagaattgtatactttagtaatctcagtgctttagcaggctgaggcaagagtatcacttgagtccaggagtttgagaccagcatgggcaacatagcaagaccctgtctctaaaacaaaaaaacgtttaaaacattagccaggtgaggtagtatatgcctgtagtcctagctacttgggaggctgaggtgggaggatcacttgagccagggaggtcaagcctgcaagtcagctgtgactataccactgcactccagcccaggggtcagagtgagaccctgcctctcttgaaaaaaaaaaaaaaaaattgtatacttcagtctcttgtgagtttgattattgtgagtcagtctctacataagcaatcaactaatcaattccaggtcactaaccaggcttagggataggtccaggactctagaacatccccaaggtgatgctccttggggaagtctcttagaagccaactagccaggtttatcttgacaacacctagccttatcatcattgccttccaaactacaacggggaccagttagatctcaggtgggaaacaagaaagatgtcttaggtaagaagcccaggaagacattacattctttctaccatacccatacaagtcaaaaatatgacaagagagtccttggggaaacctgaccatttgggggcatccaaaatagaggactcccatgtgctcaatattaatctgggcttcaataataataattacttattgggtacttattcaggtataagtactttagatctagcaatccatttcataggtaaggggactcagaggttagatcattcgcccacgtcaaacagtaagttgtggggctgggatttgaacagactgggtgacctcggcaacatttacagacttttagggcacaaactttggagagccatagaaagtgactcaagacacacaatgtaggacatggcatttcttgccagtaaaaagcttgtgattctaaatttgtatttttccttctaaatagaggaaggaacttgttcataaacaagactaggagacctgataaagatcattacatactgaaagaaaccaagagaagtgcaaagtagagcaagcctagtggggaagctgctccagtgccctgccccgagagctcaggacctcagctctgagcagcagcactgggacctccagggctttgttcttataggggcaggaacaaagggtcaggcattatcactctgtcctgcagccaggtctataggccacagagagatggaaagagatggggcttggtggtctgatggttttggtttgactctcattcttctcatactagttactatcctccttgaatcagtttgttcacaaatacctcccttgcatggctaaagtacagatttgatgagatattgtataaaatgtgcctggcacatacaaacttgctcaaacaatggtagttcctttcccatatattttctcatctatctgtaagaagtaacccagaagaaaggagttaagagatcacttgctccctgtctggagttgcctaaatgaaacttctgtgaaaaaaggaaaattcatcgccgcagaaacttctagtcagatgcttgccttgtctaaggaaggactctgcattaaacaagttccccaccaggcatctctggagaaaagatgaggattgattaactggaaaagggaggagagggggtgcccatgggaccatgtggcaacccctgcagcctcggccctgcctgtctctcactagggcaggacacaagtcttgccaggtgcccatgggagaccagccttgcaagtgggctttagccaggccctcatagtggtaccccagagtgccacgctcttccacaccaagagaatggctatctgatggtgagttctgagaagtacctgcatgaatagctcagccctccctcttctgtttctctagggaattagctgctttcaggggacacacattctgctctgtttctccaagctttaatatttaaagagccctactttccccagtgggcaccccctagggctgggggataaatctgctcaatgcaatattagaaaacctacttgcctgttgatccaaacactttccaacaccagcttcatcagtcatacgggtgatattagtctctgaattcccaacaagccttaaagcttcagtgaaggaaagaggtgttatttattgggcctccttaaagacttcaccagacacagatgcccaatcctcttgagaggaagtccaccactctccttgcggtgtttttggagttgagaataggacccaggactgtggatggtcagagcctcaaacccagtgcagaagtcttcttgatggaatctctggaggggaacagacaggggctagaaataataagacctaatgtataccgagtgctaagaatagacagtgggctaagggatttagctttgcttttttttgggggggggtggtatttaactttgtaaaatggacactatcattacaggtcgagcattccaaatctgaaaaatctgaaatctaaaatgctccaaaatgcaagaatttctggccactggcaagacactcaaaggaaatgctcactggagcatttcagattttggatttttggatttgggatgctgaactgggtaaatatgatgcaaatattccaaaggccaaaaaaaaaaaaagtgaaatctgaaacacctgtggtcccaagcattttggtaagggatactgaacccatattacaggagaagaaactgaagcgccaacagattaggtgcagctcaagggatacagctggtcagtggtggagccacacggtcactccagggtccacactttccatagggacactgtgctgcctccattacaagatgtcatctccccactgtgataataagggaagagctggccaacactgagcccacctcctgactcagagcccggggttattttcaccacacctgtatgagcaaagtcaagaatgtcttcaggctttcttctcctcctgatgagccaggaagcttgggctctctggaaacaccctcttgatttgcttatcagccacagaactctctgtggcctctctgtgtcccttccctggtggccactctgggaaccacatcccacccctagagccaggctgtgtgcagtgtatagtctcatccctctcagcctctctcattgagcccattggttcctaaattcctgttggttttgctgggatgactcaacttccccaacaccctgcactcaccaatacctggattccaccaagttcatacaacccgatttccaccaagccgtggtggaatgacctgactcatttatacactatgctcacaatttttcccatgcctgtgttttacctatgcctttatttacttaatattctttcatttgagtagcaatgggccagaaaatcaagactgaaaccccggttggccatttactaactttgtgttgttaggcaagtttcttgccctctctgtgccccagtttcctgatctgtataaggaggacaatgacagtaactacttcagagggttgctgtgaggactgaatgagcgactgcaggtaaagcattaggacagtgcctagcacacggtacacactcaccaagtgttagctaccattgtcattacttttatttaaaagggaaactttatattcctaccttaaatggaaaaagcaataccacttaccacaaatagagttataaaaataaataaaatgaaaacggttattaaaccttagctaaggcctgctctcatttttttaagaagggaaacaaacagaaagatggtgaaggcatatgaggcttaaatgagggtgaccaaccttttgaatttgtccaggacctgtcccaattttagcactggaagtcctgcagcaattctcattcccggctgaccctggacagtcggtcaacctacctcaaatagaggctttctctccttcattcaaaggaataaaaagaacttaagaaggaataatgttcttacaatgtgatgttgtgtgtttaaggctgggtcagtatcccacatacgatcatcttgcagaacaagctcacaccttgggccacaccacacaaacccacctctgagagctgagtctccaaatgctataaacctatggaagagccatcatgtcacatgtgccactgagaaagtccccaaagaaaaatcacatttgtaaatgccaagaagaggaacagtgattaaattgttgcacggctaaaatgactctatgttataaaaccattgaaaaatcatgttttggagaatctttaatgatatggaaaaaggattatattagaatgctcagttttaaaaagcagactaaaaaatagcatatacactaagatcctagttttacaaaatatagagaaatgtaaaggaagaaacacaccataatataaacaatacttatcactgaggaatggtattctagagggttttttatttctttatatttatttctgaatttcttatttatatccacttctatattttccaagaaagtctagcaaagaacatgcattacttttttttctagaaaaaactgaatagaaattacaaattacaaataaaaaagtaataggaagaaagtaaccagagctgattaagcccagccttagcagactttttttacatgtcttctccgctaggaaaagttttcagtctggccgggtgcgatggctcacgcctataatcccagactttgggaggctgaggtgggctgatcacttgaggtcaggagttcgagaccagcctgggcaacatgacaaaactccatctttactaaaaatgtaaaaattagccaggcatggtggtactcacctgtaatcccagctacttgggaggctgaggcatgagaattgcttgaacccgggaggtggggttgcaccactgcactccagcctgggtgacagtgcgagaccctgtctaaaaaaaaaaaaaatgtttcctgtccgaccaactgtcctctgctttccacctcccttggagaaagcccttgcagagaaggcagggcttgtccagggtcatgggcgtgagttacctctgctaagactctgaatttgaaggcccatttgtgaggctgccctggactgtcgcctgaactcagagtctagcctccaaggtccacaggactaacatgatatcccctttccctctattcgtgattttcctgtgatttggactgtgacactcagtaactgccccaggacctaagttactaactagcggcagggtgacatctaatgcaggaagcgcccgctttggaccaaggtggcttgagctggagtccaccacctaccagctgtatgcctctctcctcatctctaacatgaggcttaaattaaataacagatctagcacagatcctggcacaaagtagaagctcaattaataccaattttctcccgtttccttttacattcactacctgagaactcagctctccatctccctcctctgactcagctccccaaggggcaggggcagggccagagtctgggggccccaagctctcttctccctatctacccaggcctctgcttctattcagtcagcaaacaatccctctgctgaccaataagccccagagagagcggctgaggggcagtccaggctctgtgaggtgacccaggagaggaggcagggtgagagaggtgggtaacttcaggcccccaccttgtgttctttagggtcaaactagatgaatctgatcatcaggcacatgtacaaaatcaacccagggccctgtgtaaccagaacccactttataagcattgtgtccatttattcacagaaacatgattgaacctgagcacttcgtgtgctcccggcattctgggtgctagacacacaacgggtgaggaacgggataaggtctccgcccttgcagggctcagtctgctcctccaggaggtgtggggtgcttctgtccacctctgttacaaagacttagaggagaaaggcagggctttttagaaagctgaggacccatcacgtatagttcagcccatcagtcaaggaacctagcttcctcacacagacccacagaactcctcatccccaaaccatgagcctcctcagcctcccagggattcagtttcaagtaggtttcacatggccctaacttcctcacccaagatactatttaaattccctgctttgtcacttggtggctgggtgagcttggacgagtcatttaacatcccctagccccactgtcctcacctggagcagtaaggtaaagatacatcccccatggcattctgtgagggggcatgtgaaatccctcgtggaaagcctcagatgcaccatgttgcaagggggccggtgattcccccgctgcactctgacatggggtcccaagcagacgggagctgaccatggaggtcaagagcagagcctccagagaccatggcctggggctgagcatcagctgtgcagtctctctgtgctaaagtgtcctcctctacaagaccagggtggaaagaatgacccctgctttgtagagctgtgggagtcatgagttactgtatgggaaggggaacagtgttcaatacatagtaagaaccatgtgtttgctgtttattttctttcagaaatatatttatggggataaccaatcatgtagtagcagctagcacatggttatccctccaagatgataaaggatacaggaatgcctcccttacctccaagcataaagataggtgcatccgctgtgaatataaacagccacccaccaaatatgcatgcacacacacacacatacacgcactatggaatcatggacagtacaaacatgataatgacaactgttttgtccattaggtcaaaaatcgcaagacacaattggaggcagcatcataccctggcattcacgtctgtgttgagaggcatgggcactggagttagagtcatacaaactcatacagggtttgagtcctagctccgctccatcttggtggaacgaccttaggcaagtcacttaacctgagttccctcccccatagaactgttggggtaggggagtgcagggggatgggcaactccacctgcctcactagcatgtcatcgtccctcggtgggggcaatacaatccttggcaggtcctgactcctttggacccccagcctcacagtcccaggaagcttcctccttttccctgcaaaagactctgctcagaccagatttacttccctgtgccaccccagtgagcagcctgaagagtgttcagcagctgccgagctctgggaggctggagtgctggccaggggtcccagaccccgggctgctgtttactcaaactgcagagcctctatagcctttacaactgtttcctgggcaggagggagcaagacagctgggcctctctctggcctctggcttccactggcttttcctttggaaaaagccagttcaaatggtgctcactctaggaatcgcttcaactcggagccctggaggtgagcagggccgggcacgggccgggcacatacaccccctctagggagcagggaagggcacaggccaggggaagctggagacaaaagaggagacagggacagagataaaaacagggactgtgacaagaacacaggatgggaagggcagagacagaaatagaggcaggcttaaggatctagacaggtcatgccagcccaggttcaaggcagaggggcgtagggggacagagagagagacacaggaagcacagaggggagaaagctctgcttagcagacttgccaaagctgaagaccccactgttgccacaaaggggcccacaggaaagctaggggttgcaatcgcctgtcaggacccacattttcaccctgagctgtgcacactttccaacggcaagcaaaaggagcacaatctagttaagttaggactggcaagattcacttctgatttaaaacttaagacagcaacaataaagatactcagctgaaatgccacccaacaaagccagctcccctggaaagttaaagtttagcacccccatcccagcaccctgtacctttaaggaagagaaggttccctccgcttcccagccgaagaggcaggttattctaggatataggggaggcttacctaaaactgagttattctccttt

SEQ ID NO: 947 - DNA, 120899 bp, Homo sapiens
agaggtttggaaatgtgcttttattttcaaactcaggtatgtgacactctacagttcaatgctagcacacctgtgtgaggcttaacaacatgaggaactgatagccagtgatacacaaatccagcacttcctctccatttactctgtcaggctgtatatggggagcaacacatatggctttgtggcagccagaaagtgaaggtctttttaggaggtgacatcaacaatgacacaaacacatcactctgcaactgaaggcagggaaccagactcctagggctaagcagagatgtcagacttcagaggcatttgggggactcttcagatccacatcctcactgaaaatccagggcctgtttctctccagttcactaccgcttgggcagcagctcccactgcttcaggctggtctttgctttccagaaaagatggactcatgagcactttttcagcccctgtatatatggctattcttatgctcccttttggagatgtccttttcctcgacctcccttgcttacaaatggaatagggtgggagagggcctgtgcctggaagtactcttgcaggcttttctgtggggcagctggaggtgcaggagctctccataactgccttcctggcctttgactcatccagaaacaaaggtaggaaacttgtgaccaagtgaacaatggggccagctgagcctggccctgctttaagggaggcagagattgaacattccccacctggagttctgcttccacggccactctctagaactctatttgcatcctgtctttggctctgagggcctcatgtagctaaagctccttcagttgtatccagaccccctggaagaggccgggcaaatcatccacttctgcccccagagtccctctgccctgctctgtaactctttaccttaatggcacatccttgatcaaccctggcttgggcctcagtcattttctagctactgtaaaggatgcccccttcaataaacatgctattttaaagtggggcatgcttggggtggggggtctctctgaaggagtgactgcattgagcccagtccttgagcttggcaatggtgttgctagtctggtctcattcctgctctctcacagagtagactgaaaaacagaataagctgaggttaagaaagatgttgctttttgcattgtgatggtgctggtactgagaagcatgcagcatgtcagctgtccccaggctgctctccaccaccttaaatgtttgcttgttcttttgagcaacatttaatgacaccctcccaagcgtcagccaccatgctaggcacttacccaagagatgggtaagacatggttcttgtctttgaggaaaaatgctaggggagatggatacataaataggccatggtatactataggtaaaggtcaataataataatgtttaaaacgtgccagaaagcacagaggagtgtgtgacctattatgttgtgtctggtgaggagtatggaaggaaggtcatcaaagctggtatggaggggataatttttgcactcggtcgagaagagtgacctgaagaaaagagaagaacagctggaaaaaaaactagtgagtggaggtccagcactatgagagaaactgtttagttggggagccagagatggagtagctgatgggccacttgggggaatgagactgaaatgtgaggcttccagctaggagaccatcagaagagtcaaggagagcacagctctggagccagcctaccctggggttgagctccagccccatgatttactaccggggtgtccttgtcaagttacttgttctttttgtgcttcagtttccttatttgaaaatgggaagggtaatatccacttcgtatttttttttctttttcttcaggacttaaatgaattcatacctatgtaatactgagaacagtgcttggctcatagtaagtcgtatatgagttttagcaatgaaagcaaacaatatcaataacaaaacaaaaatgcaaaacaatgacaacaaaacccacatggaaatcaaacctctacaaaactgatgaaggcagtggctgtaaaagtggggagagaagtcaaaatggagaggggatgtgctccttcagtgttgtgctaaataactggggatgctctgaaacacccctaattatactggggttggaaaccccatttgaactgaagcactgaggtgcaagtttactcttgcatgtggtcacacacagagtaagagactgaagcagaaagcacatcttctctcctcattcacctgtgaggtgggttaactgttttcaaagagagaatagggaatagattgtgctgtacagcagctcagagttggcatttgaaatggagactagtaagtctgccattgaagccatgagttttctgtgtttttaaaacatcttcaatccatgtggacagctcattgaacaggtgcctggtgactgccccacactggtgaaaatctgtgggttggcttggcatgcatcttatttatccagaggtacacacccagagcacacttttgaagggttgttggctctgtgcacaggcatgttgtgtgtgtgtacacaacagtatgtgtgtatgtgtggacagatgcgtatataataattcatatcttcccatttcaagcactgagctaaattcagcctatacttttttttttttttctgagaagcctttcctacttctgtaaaaagaaactctcattccaaaggaaagaatgggaggctgaagttattgaaaatgagatgggaaatgggaagatagtcactttgcaactccaaattccaggtctgatgcttagggtgttagtcattaagcaaattcttcctgataaccaattacagagaggaaaaaagagagtaagttttttactgccccctacctcctcctcccccgtgccccgctccttacccccaaccaccagtgaaggtgttttagttctccccagccacctgagctaggggcaggagaccttcccttccaatagagttccttggtgaaggtgacttcttcatccactggatgctttcccagggcagttttgttgatcctccaagaacatcaagtcactgtgtatgaatagctcccacagaagtgccgagtgttaaaagaacccttcctcatgacctgatgggatgggcggcagtgtgtccacacttgggcctgacgttatacttggggaaagggtggtagtctgagtgtctcagagcagggcactggctaggtgtgaggtttcctactgctctgtaggctgctcatgctggagtcctgagctccaccaggagtccctctgggctgccgagcaagtggatcttccaaggggcccatcagcctgctctgcacaagagttataggaattgtagagccccagcacaacagtcaagaccagcatcactgcagccatcatccagatcacttgccagtgctgacacagtttgggatacatgacttgtaagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttatctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctcaagagttcacttcaaaccatccaagagcaggcagaagattagaagcctctagcaatgtctgggtggtttgttcatgatgttatctcaacctcattaatatttattctctaatttctccctcttcctcctcttcttccttcactctctccacacttctttctctatccctttcatctctctcttcctctccatttttgccccttttccctcttgattccttcccaactgtctttcattttgtcctctctctctctctgtggtgtggtaaaaagacaccgggcagatggcctgctttgacaagttcattctagagctctctgaagaagccctgagccccttcattaagccaggatttcctgatgtttttaacctctaacccaatttaaaaaataatatgaaaaatgagaatactgaggattcctgaaccaaggaggtggggaaagtgatagaagtgctttctgaagatcctgaggctcatacacacacagcaatgaccaagccattggctgagaagcggagagctcaaattttgaggtagcagaaaatgcatgactaacaaaggattgacagactcaataaatgccctccttagaaagggaccagatgctcagaatgcctgccttggatgctagggccacagagaacattgacaggtttccgttccatgcgggaaccccatcagatcatttcagtcacaattaaggaaagcacgaaagtgaacacattcgctgatttgaaaatcattgactattttcacaactgttgggaaggcagggtttagaagtagaaggttattttctctcagccctttgtagattctctagattctatttagacagagttggatgctaaaatggagcctttggggctgtatttccatcctccaaaacaaggtgccagagtggcttctccctactctaaccccactcttaagtgtggctctggaggaagagaccaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggtttacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggactgagaaatatcagcagagaaccctcaggagggagatgaggcctaaggagaacaggatctggttgcttggagtagggattgcactttaattgttaaacttggaggttctttcactggggagacagtgtgtgatttgttttcagtggagaagcatttctccagttctcctaacggctcttcccctgaacaatggggtcgaccagcatgggctgagacctctgactttagttgaattctccaccaactgggctctattgatagctcctgtgtgcctatccattttgcttctaatcttcacttcattacctatttgttgcatgcatgtggtttccagagttttccagcaatgaggcacagatacatacccagattagataatatttcagcagctgattagatattttgtctggagctgccctggaccccaagatatcccaggggtctaaaaatagattttggtgaaggttttccaaggtggctattactacattttaaaaaatcaaaattcaagacttgtggtttaactatactaatagagacaacatagctgaatatatgaaattgggctgtcctgaaaatccagaatgttggcatggttattatatctgtggggtagagtaacacctcatctatgggtgctagtttatcctatccctaagcgtgaacttctaggggataattcaggccaggtggggctgagacctcattcctataatacttcattgcatggagtgccctggaactaaattaggtcatttctacgattctgcatcctaaaggccaggcaggaaccacaagtgggacaagatacaggtctatattctctttatctacatgttatattctccttccccaacttaggggaaagtacctttgaaataggaagtattttaaaagaaaaccccaagtatttccaacctaaagtgaagaccaagcttgattggtcagcatggtaggcacctgctggagactcacctttgccactgagctgagtttgccctctattccgtgtgtcctccctgtccctgttcttgtaagaaactcactccagggcttcgagtcaactctctttgtcttgggcctcttcatggggatggctacccataatttcatctgggaaatgagctaaccatggctgggctgggagggactccattcagggcccttcgcccttccttagctcctggagctcttgattgccatcctcccttcccatgactgcccctgacctctcaagctcttgcaaacttctcattgctagctatcttggctctttgggatttcctctacctccttcccaacatgtgtgccctcttggtttcttgggctactcactggggccccagattcactgctgccctggactggcatttccagggattttgtgcatttaaattagatgaattgtaacccccatttcagcaacggcaaggactccaaacacaggcttcccacctgcttcttgggcccttttcctcttcctcagtttcttctacctcttcaggttcctcaggactctcactcttctgttcttcctcctcctccttcaggtcttgaagttctttggtcttctttagaccttcttggaatctggggggcaaaaaggaacagttgagtctggaaagggcagatgcagtgcatcctttcctgagttcctaggggaggggacttgagcagcacctccaataattatgtgcttcctatggttccacaaaacaggaaaaagctgggaagctccactgaatcctaaggcagctcacgccagtaccatttcccctcactcctcagtcatccttcctgtttatgtgaaagtgtgacaaaactgacagggaaaaaatgtggtgcagggtctcctgactgggttcttaacccacaaaacattccgtagggctaagattgtatttgttctccatgtgaccgtggagcttcagcctctcatctgtaaaagagagagggtgacactcatttcacagggcgttggaatgatttttgcaagtgccaggcacatggcttgatctagagaggtactcagtaaatgtttacgaaaccaatgaaggagttcatgcccataaattccaaggatagagcacagtggtgggtgagaaaggcacgctttcaaagagaaacccttgtggtttttctcccccagggtcaatattaccccaaacatactctgttcacttgtcctatgctgagtgtctaacactagcagtttggctgggcaaacccaccactgaagcccatgggttctgtgccagtgggaagctatgtcttcctcatgagctatggagacaggagacgcatagggcaccatacatggttggaggtgattctctaccttgaggcttggtacctgctcaggacttggtctctccagtgctgacaactggccatgggtgctattgaagctcaaatggaggaggaggcagttcgaagttgaagagactccatttataggaggaaggagtgaccaaagcagttctagggagcagagctgcagctgctcctgggcactgctggcagcaacatgactgctttgagcacgtgtcaggaagcctcaggcaccaccaagaggaacccatccaggacccctgatttccagactattctgagcggtggcattctggtggctctctgcctaaaaagagggcagtcttgttattgtctaaccacaccctctgaccctgcttcctcctgtccttcctgtggaacagtcttgctctttcctatgtagttccttcctgtggcaaggaggtcctgcggccactggttacttccctaaagcctctaagaaacaagaaagacccatgggaaggcatcttctgagaactgccaggtgcccttggggtggctgaggtctgactcaccccttgctgtaggcttcttcctccatcctggccttggtctcctgactaagctcctccaggcagctcagggtcagcgcaggagcagaggcttcacaatctgggtccccatttgtctttccactagtgagaagagggaagtacagggcatcatttcagaaaaaggtggaggcctaaaaacaaaaccatgtttttggcccgattcctgattaggagtgaggaaactcaggctttttcagtaactttcagattttttcccaatccttctaccctgagacaagattttataaaggtcctagtccatgaattttccccagcccattaaatacctcaccagctccccttctcctcatgctcccaaactggcgtttattcttattccaggagatgctgtaatgggtgatctacagcgctgagatgaggaaaatgggggcagaccagcacgtttaaggtcattccattcctgttgtctatctttcacctgaagacccccactcatcttttcaaatatccactcagcatgactaagccacaggcacattgtaatgtgctgggggcacattagaaaataaagaaatggtttttaccaacatggaacttagcagaaggaaaagccccaaaaaaggaaagaaaaaatatgtgattaattacaaataataacttttatgaaagaaattctgtacagtgacagaaaataacaaggagagaatgtgtttagagtgaatagttagaaaaggcctctctgaggtgctgaagttgaagcacaggcctgaaggatgagaagtcagatgtattaatagcagaggagagggttgggtgtggtggctcatgcttgtaatcccagcactttgggaggccaaggcgggcggatcacctgagatcaggagttcgagaccagcctggccaacatggtgaaaccccatctctactaaaaatacaaaaattagccaggtgtggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagatgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaaggcggaagagtaaacagtgccacacacttctgagtttgaagcgtgcagacaaggtgactattagatttgataatacagaggtcaacaggagcctctgtgtaatgttgggagccaagcacaggtttaaagtaaagaaggggaggttggaaaggggaagccacagacacagcaattcgagtaggaaggagagtagaggggtgtgttggagggagtgtgcagctgaagtaggtcaagggaggatgcacatttgaatgtaggtagaaatgatccagtagaggatgagagaaagggatgcccgaaggaactcagtctttgcaaaaggaaatagggacagaccttggaaaactagagaatctctccttgtttgtaacaaaggtaagatgatgatgaagttgttgggctggagatctggtgaaggaaagtgagagggctcctatgggaatgtagcttaggtattctctataaagtggaaggcaaggtcatctgctgagagtgagaggtagaggggtctaggaaggtctgtggagagaggaggggtgtaaaagagttatatgagaaagaaggaaaacagacatactagaacatcttggtaagatggctgggaggtgctgggagatcattgcaggtatgggatcacaagtttaaaggaagtatccagatggctatgctttccctagaaatcctgcagcccaccttcatgtcctgattcccaatgggagcaatgtcgtcatggaggagtcctccaacaaggcaacactgtgagcagagctttccagccaggactctgaaagatcacagctgccaccctccctgaactctcagacagggtttatgagtgagccttgtatcttctcctcattcttggcatcagtttcccatctcttagttttcctcagaccttttaaaatttacatttagtcaggctggaaaccacaacccattgtgaacaagaaagataacgctctaaaaataccagctgttcataacatttctccttttgcaaattacattatccactcccttccatgtgaccttggcctaatgtgcagtttcctatttatccaaacgactggagcaagaggagaaaaacatagctacagccaagggcagggaaagtaattctttcatgaaatatatatatatatatatatatatatatatatatatatgaaatgagatattggtatcagacttttgatttatatacaactgtcagccttagaggttccttaatgttaagcatgcgtgaaggaggacagtgtagtataaaggaaaagaactcgcctgaggcaaacttggattcaaataccagctccaaaacatgcaaattatttaatcttcctgaacttcagattcctcaactgtacaatggggatagtaatacatacctgatggtggaggtgtaagaattaatgaagaaatgtcaataaactttctggaatatggcactcaacaaattatatctgctattattattgttatatagtaaatgtattggtacattttgggagcaatctgagctacctccaaatatgactcataaaaaatccaggcaattatttatatcatcaagggagagcttgttatatattactgagacacttcagagtcagaggaaccctaaatgtgaactaatttaaggtatggtaaattaacattacattttcataaaatggctttaggaactttctcaggtgcatgtctattgtgtgtcatcacacattatgcaccttagaattttgcagataagtgactgtaaacaaagctctcattgtccttgggtcactgatctctagagaggaaaacttttccctagcagggccaggaagcccatttcatcgactcttttacatgcagatcttctgttcatttcagctcccctatagggctctcatatacattctctcacttgatctttccaatgataagaagagctaaacattaacttatatgtatcaggctgtggtctaacatctcatttaaggctcacaaatgacccaagaaggtattagtgttctctgtttgacagatgaggaaaccaaggctcaaaaagtaggctgaggcatgagaatcgcatttcaagtgatttcatatctgtcaaacagagaacagtaataccttcttgggtcatttgtgagccttaaatgagatgttagaacagagcctgataagtaagttaacttttagctcttcttatcattggaaagatcaagtgagagaatgtgtatgatctcgggaccagcccaagatcatacaaccagtgtgtggtagagctcaaattttaccctgtgcagtctgatatgtgcccattcttctgactgcactatctgccacctaggtggggtattatcccatttcacagataagaaacccaagctcaggttgattaagtgacttgcctaaattcacgttattggtgctgggactctcaccttggtcttctacctgtgtgtcaagatggactttccagccctccatgaacccccgcttttctttcaatagaagccttccatgaacccccacctttctttcaatagaagccctccatgaacccccacctttctttcaatagaagccctccatgaatccccctgcctttctttcaacagaagtctcttcctttcactctgctgagtgaagcccttcctgccctcaggctggaccatggcttccatgctgcccctcttttcaaggctgcttgtctacagtgtaagtggctgggagggcctttgtttactgtgtgtgtgtgtggagggtgggtaggggggagtggaggggttgtgggtagggtggcaagtgggggaaacacaacatgtaaaatgtttgctgttctctcctgacctctaaactgagcttgtagtttcctaaatatcttctctaactatctggaagtttctctctaagcatctttaagactaagctcaaatgccttctcctctgtgaaacctttgctggtgttctcccctcccccacaccctctggttaaagttgatctctcctttttttttttttttccttgagacagggtcccgctctgtcactcaggctggagtgcagtggcatgatctgggcacactgcaacctccacctcccaggttcaagcgattctcctgcctcagcctcccaagtagctgagattacaggcgtgcaccatcacgcctggctaatatttgcatttttagtagaaatggggtttcaccatgttggccaggctggtctcgaactcctggcctcaagtgatccacctgcctcggcctcccaaagtgctggggttacaggcatgagccaccgcacctggccctctctctccctttatgctgccaccgcacctctgtgacagcatgactcacagggaggcattgatgtatgttttagatacctgcatatgactgtcatcacaggaagaaggactgtgtttgggtcagaatagtgcctggcatacagtaggtgcctttaagtgcctgtcaagttgcatcggtttcactatgacttatccagtccctactaggaatgttgtaaaaggcacaagtcctctctgtaaatggttatttcctgagaacccagtgtttgggttggactaaacgaatctgtaatcatggctataaactggagctgagcacagcctgtgcccaccctagggatttctggcccgaaggctcatggatcttggcatctgtcccctgcctgaaatcctatgtgctttctttctgggatgattcatgaaaatgaggctcattattctcacacgtgcaccaggtcaaaaatgtttgtcattgtgctcagctctcagtaatgtgaagaactatttagtcaaaatatatttttggacaggcaggtatattagattcaacttttcccacatggtaaacaatatttgaaagtggctactatcctttgtgatcggcatatcttcttgggctcagcaatatttccaagtcacccccactgccatggttccctctgacaagcccagcccagggaacccaagcttccttactccgtgttactcagttctagatacctggggtccgccacaagtttattggggtgggtggcgggagggaggaattcactccaagataccatcagcaaaggggagttgcttactgtacaaatttagtgtcctgtgaaatctttaaggaatttaccctgggtgcttcaagagtatagaaacatggttatttttagagattcagagttaaaattgctctgtgatacattaacataataacccctttttgacactaaccctgtgcatcatctacatcctggttttgctgatcgctctgtgaacggttccacacacaccctgtctctcaccccgactctgttctccactccatgcccaaccggtcaccatgctctttcaaaaatagctcttaaattcatcctcttctctatggtcacactgaacttcgttttgttcttccagttgggcggtctattaaaagggtaagggcatgtgctctgctatctaccagctgtgtaacctcaggcaagtgacgatttctctgagcttcagtttcctcatctataaaacagagatattaatagtacacctacctcatggaattactgtgaggattaactgagattattaatacaaagcaattagcaaagcacttggcatacagcgaggtgcagcaaatagttaacagtaattaccattgtcatcagtgcagtagttaacagtaattaccattgtcatcagtgcagtaaatagttaacagtaattaccattgtcatcagtgctgtaaatagtcaacagtaattaccattgtcatcgttatcattatcatcattccttgaatactccatactttgtcacatggacaaagcctggaatgttgttaacctcctgttcacctagttgattatgtaccctttagatttttactttaaaagtaagttcctagagggaaacttttttttttttgttttttgagacagggtctggttctgtcgctcaggctccaggctgcagtgcagtggtgcaatctcagctcactgaaacttctcccggctggggtcaagccatcctcccacctcagcctcctgagtagctgggactacaggtggacgccaccacgcctggctaatttttatattttttgtagagatggggctttcgttatattgcccaggctggtcttcaactcttgagctcaagtcatccacttgccttggcctcccaaagtgctggggttacaggcgtgagccactgcccagccaaggggaatcattttctaagctctctcttccccccacttccccagttcccccaaccttacaccaaaatcaggttaggtgctcattttctgtgcatcattcccttagcaacctacacttccttacgatcccacccatcatgttgtattataataggctgcttcccatctgtctttcccgctagactgcaagctccttgagtacattctatgtgcctggcccttggtgattaattgctgaaggaatgaaagaacaaaagactacaattacatagccatttctacttgtggaactgctcttgagctttgttttctcttcatcttcaggactaactttaaatatcactctccacccatatgtttaagtctacaggtttctaggcccttggtgagtgaagagcagttcattacgaaatgacctccaagaacaaggctcagcattctctgaaatctcatgaagcagtgtaaccagctctcaagtatcttcctgtgaactagccacagggtatttgatcttatcctttgcttagccagtgcccttcctgctttgtcactgtatgcttaggaaaggtgaaatcattttaacacaaagctgaatacaacagtctccaaagcaatgtatattaaactataacacattatttctctttcacgatatggatagggcagttagaattgactgtatttgtgtataggacagaagatacgaattcacttttactcatatattgtctcattgttagtctgttgggaatcaagtaaattttccactttatatttatttatttatttatttgtatttttagtagagacagggtttcaccatcttggccaggcggtcttgaactcctgacctcatgaaccacccgcctcagcctcccaaactgctgggatcacaggtgtgagccaccgtgcctggccatgtttccagttttaaatggaaatcacttaacatctttgagaaatccagaaggggaagctgttgttcatcctgaacccctcttcctctaaagatgccctcacctctttgcaaccattcttacatgggtatattcccaactggcgagtcagccccagtgtgcttgacttgccttaatccccactctgtccatatctctccaggttctataaagcactggaaaggtgatgccactattgatcgtcacccattgacactcctaatttggggctgctgcttattgtctccaattttgtacctcagtttcccttaccaaggataattcatgttttcatgatccccactgccttggacagaagtgctcaactggcctggcataagttctacagagttcaggccctctctgtcatgattaagagtctgttgaagagatcttctgccttgagtggctctgcaggcctagagttgggaaaggggctagagttgagggttctctgaagtagggatctgtgcacccaaagggaaggttggcagggagaattttagtgggtttctcagtcagagcatgaggtgaccatttctggagagattcagagaccctggatgaggtactatgactctagggacttggtaagtttctgtaaactcggttacttccatgtggtggtggttgtgttgcctcttgacaatttccctgtagtgatcaagaaaagacagagagagagaccccaagagaccctctataacacgaaggacctgtgagcttatgggggtgaggtggcaaagagacgaaatgctgggcaaacttcaagactaacaaatcactgggtgataagctggtggctatacagaatgacagatgtaggaggcaggctgagtctggagatgggagcttgtctgtactgaaaagggtcccaacatacaggttccctgccagatagcaaaacttttctaacagcaaagaaaaacaaaggactaaagctgtcttgaggcaaggaagaaggaagaataaggtatatgttttaccaagtgagaaaagacacaaggggaaaattctgagaggcagcaggtgtgatccagatgtttttcagcaagcaaatgaaagaatttgaaaagtaagctataaaatcctctgagtgcatagaaacagcctgccttactctggctgaggatgaaaagatctgcaaattgcatagatgcctagaaaatcacagaaactgctggctgctaatccaatatgcattttccttcctacttcctaacagcaacatgattctgttcaggaatttactcttcttcatggagtcattttgctttatgggaagctgaccctctcaccaaccccagggaatagtttaatcccataatgacaatccctttcccaaagtgattcttttagaaagggacttccttccagatttgtcaatgagataatagagaagactggtgaaaggcttctgggtttattcctaagaaaggaacatggcaagaaacagtccctttcttcctctaggtattgtcctgtctggaggggatcccaggaactaccagccatttgccacaatcctgatgatgaagttaacatacaatgtggccagaggcaaggaagttgtagactcgctgagctagagccctgctgtgccataccaggagcagctctacctctggacttaattaagtcccattgagttggggctttattttgtctgtagcccaaggaatcccaattggcagagaaggctccagccttctctgggctctctaagattgggtacacttggcctcactcagggcatcttcctggttcaagaattttgcaaacaggttctgaaatctttgtgggtttcagactcccattcatttcccttaaaacttaatttgctttccactgcattttggggataaaaatgggaggaaggaaagtaaaatggggaaaatttcctgagagatccctgaagccaagaggaaaatcgacaaacttacttttccaaaagtgcaggcagtgctgaagtgacaggtaggctgcctttcccattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagaggagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttttaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaaaggcctgggatacagaaaatattttgttatatccaaacgtctttgtctaaaagaaatggaaatgtatttttcctgattattaccaatacattcttattatagaaatataaaaaggcatcaggaagaaaataaaaatgaactattttaccattgcctagagataaccattattagctgtttcacatatcttctaccagaaatttctatgtctacacacagaaacacactcttttaaaaagtacaaaacagaattatactgtttatacactaggttttgtatattctattttacttgcttttgattcataataaattatggataattctacagaaaccccttataggaatatccatttgcttaaccaatctcttattagtgaacatggagttgtttcccacttttcattattatgaacaatgctacaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcacttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacacaggtaagtttcaggctaggcaccagcaggaaacagaaactaggctatcgtatccatgggccagaactggccctcaagggatagcccaagggtctgggtgttggggacactgagtttggcacttcatcctttgagatggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagagcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgtcacgtaggctggagtgcagtggcacgatcttggttcactgcaacctccggctcctgggttcatgtgattctcgtgcctcagcctcccaagtagctgggattacagatgtgtgccaccacacctggttaatttttttatttttagtagaaacagggtttcgccatgttggccaggctggtctccaactcctgagcttaaagtatctacccgcctcggccgcccaaggtgctagaattacaggcatgaaccaccacacctggcctgtttttttcataatctaatctgagattctctattaaccaatagatttatactagttatagttcttgtgattaatatatttgtatttatttctaccatgtaattttatattttctatttattttgttttattcattgactttttctacccctcctcccacctgacacttttgtttggaaattatacattctatttttaacctttagcatgtcctcttaacttttgaacatactgactttaaatttaaaattaaacaagctctctattcttttcttgaataaatcttaaaataataaccctccctcttaattatattgctttccaggatttttatttcaccttgtgtttgtattcttaaattattcattatgtttgttgatttctacagagagtgcttatttagatttacccacgtttacaaatgtctttgttgactattctttcttgtatcctacttgtttcttttgagctcaattttttttaacttttattttaggttcagggtacatgtgcaggtgcattacataaacttgtcatgaagatttgttgtacagattatttcgtcacccaggtattaagcctagtagacagcattgattttttctgctcctctccctcctcctactttccaccctcaagtaggccttggtacctgttgttcccttgtttatggccatatgtactcaatgtctagctcccacttcttagtgagaacatgcagtatttggttttctcttcctgtgttagtttgctaaggataaggacctccagccccacgcatgttcctgcaaaagaggtgatctcattcttttttatggctgcatagtattccatggtgtatatgtaccacatttttctttatccaatatgtcattgatgagcatttaggttgattccatgtctttgctattgtgaaaagtgctgcaatgaacatttgtgagcatgtgtttgagttcaatttcaatcttccttaggtacatcctctagttgttctttcagcgagggtctatgagaggtaaactttctcaattgtctccaaatagtctttaccaagccctcaatcttgcatggtatcttagccatctgtgttatctctagattgacagttattttctcttagttcttttaagaaattattccattggcttcttctattattgccattgagaattgtcattcctttgtaagtaatcttctctttgatgacttttaagatcttccctttgtctttactgttctgcagtttctctttggtgtgtttttatttttcctgcttggaattcacgtattttctgaatccaatgattgatgactttccttagttctagaaaatccttagccattctttcttggcatattttctctccttggttttccccttaaggatggcctaataaatgtatttgggactttctcattctgcattctatatcccatatctcaatgcttctttcataattttaatcaatttatttctctgaactatacattgggtaacttcctcaaacctatcttcaagttaactaatttttcttcaactgtgcccaatttgatttaaatgttataatcaatcaggataagctaggttatactagtttaatagcatagtaataataagcaactccaaagtattagtggctgataacaaggaagatgtgatttgcttatgctacatgctcatttacttccaagtctgcagcaagcttggttctctgtttcctcactctggactcagcctaatactggccttctactattctggagcaatgatggttatcatgttaggaggaagaaacagggcaaactgcattctagttcttagaggcctaggttcagatgtgacatgtccttctactcatatttcattcaccaaagcaaatcccatggccttgccttgtgacttcaaggggatgggtaaatgtgcccagaagaaggagatctggaataatgaagaatagcctcaaatatagtaactaccacatctaaactcttgagtttttgatttctgtgactttattcctcattttgaggagttctattttattcttctttgataactgtattcttttactctgtttttgatccattattttatgtctccaataatttttgtttaagttagagacggtctcactctgtcatccagaatgaagtgcagtggcatgatcacagctcactgaagccttgacttcctgggctcaagcgatcctcccaccttagcctcctgataagctagaactacaggtgcccaccaccacatctgactaattgctttttatttttattttttgtggagatagggtctcactttgttgcccaggctggtctcactttgttgcccaggctggtctcaacctcctggcctcaagcgatcctttcaccttggcctcccaaagtgttaggattacagacgtgagccactgtacccagctacctgtaacaattttaagcttatcttaaaaaaattgtcagatcattttattttccgaggttcttaggatataatcctattgttttgtgtaactgatgacttttgttcatgatgaattgttttcttgtgtattttataattttaagttgtgaagtcatcttcagtgaggctttattagaggaatcctgtgtgtccagatgcagggtctgtctctccagagtacttttctgcttatttctaacatatcttagaagcaccatcttgctgttcttttcaaatcctctgcatattgcatcatcactgctgtcactttgtgagcacgtactttccctatgaggaaggagaaagtgttttttcctactacagtccagggtgaaacaaatttccttgtttctctgctggttggtgattattatttttccttatccaaattccatctgaggatatagtccttggacgcccttaactttctgtgggaatctgtgtcaactctctaccataggtgttccaggccttgtctcagaccacaggcaagtgcaaaagctcagctcccagataaccaaggctgacacttgtccctaaggaagctgcagggtcagcttggtttcagttctcttttcttttcttgtatctgggtatttcaatttattttcttgtggattcagctatttagacaaaggtttgctttattttgtccagcagcaatttctaagtgcttgtggtcaaaagattttcaagttttccagtcagccaaaatagcagaaccagaaaatattctttacatgtgaagagttcatataaattagtaaactaccaagcttacaagtggcaaaggtcataaatacagaatttttaaaagcagaaatacaaatgttccataaacatttggaaaggccaagaaatacaattaaaacaataagacaagacacaattgtggcctatcaaagtcatggatatttacaaaaagaaagaacaagaattgtgtcaatggcacggtgaattgagtattgtaacccattcagtgaaaacataaatgggttatttgaaaataatttgctttaagagccttaaaaaatttatttcccctgagctagtattcatacttctagaaatctacactaaggaaataatctaaaatgcagataattggtaaatttcatattcagaaagaaacatgttatttttaaaaaatgtatatcaccttccttgaaatcagggatattttatttactgcagtcttcaaaaccccaggcatagacaaagattgcagaggttgtataaaggcttaagacacaaacactattagggaacagtcatagagtatcttatggaaacacctgctgagtggttacggccactctgcctagcccaagctgaggtatagcttggaagaacaactggagtggaaacaaatatcagaaaaacacgtacagctatcgttgacctttcctacggtaagcgttttctcatcctcctagagtgaatgtgggactctgtggtgtattctcctcggaagtctgctttcttctgtcatagcactggctacactgccttgacttcccaaaggttgggagctcctttgggtctgtgactgtgtgccctttacctctatattccagtattatatagggcaaaccaaaggtactcaataaatgtctgtagaatgaacgaatgagactcatgggtaactgctcatcctataaatcttaggtaaggtggtttgcaggaggccttgtgcagcaataaatgcaggagtccacgcattaggattcctttggcggcaacttcctcagcttccaacactgacggaaaatggttagaggcctaggtgcatgtgggtcaggagccttgctgacagatccaaagctgacagtctggagcatgtgtgcatgctgcctttggactctgggacatgtcactgatattctccaggaaacttgtgaaacctcctgtttataaaggtttctccatctgttatactttctgtactttcccttctgcagctcttggtaacacggatgtttgcattccacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaccaatgactccccgttgcctagaggctcaaattgctagcatggcctggcgtgtggccctggtcaaccaagtctcacttccacaccctgacactgccactatgacaaactgtttgtttcatcttgttttcacccccaacctccacacctttgtccatgctggtttctccacttgggatgtgtcttcctctattgactggagaactcctatttttactttaaaacaccaacaagataccatccctctttgaaggcttctttgtctcccttcaagcagaatcaggtgggccctcccccgtgctcctatagcaattcgtatagaacttctaaacaagagtatttctttgaaacttctgtcttacccatgagtctgctgtttttctccgtaacatctccttcagccagactctcactccaccctaactgcccaggtttcacccctcacctggactgttgcaagaacatcttcatggggttttctatccctgctttgtcccagtaatgtaactgccacaccacagttaaagggaatcttcttaaactacatatatgatcaagtcattttcttgattaaaatcattggctggatccctaatgctttccagaataaagcccaaattccttagcatgtgctgcctaaaaggggatcccaaagcacacggactgacagggtctagggtcactctcagaccctgtaagtccaagagctcttgtagcccatgggctttgtatccatggtcagccactgtgatttattgctttgggagttaggaagtcactttggaaaggctcatgtttcctggttccagactgccctgccaggcccactgaagcagctgctgggaggcccctgtgggcagcactagacaggagtgctgctcaactggaaataagtcctggggctgttctgacagctctaatcctagccaagagctcttggaagtccaccttgtagggccaagatggggcaggagcctaggtccttaccagaggggccacagctgcggcttgaattctgatttgcaagctttttaaactccatgagctccgcatggtccttctcatacgtcctctttagattctccacatactgcatcatcacttccgttgctttcgacatgcgcttttcctgcggggaaggagcgcatgagtgcatgaggccattggaggaaaggctccgttggcacttatttgctctgacctagggtctgggctaggagaatcaaaaggatacagggacaagactctgccctctgaagagtttgctgtctgccatgtgagctgagaggtggactcagcacctgcgcttagggagaatgagaaaagcacagccaccacactgcaggagatgacaggcagaggagagttgtttctgcttgcagagaacgggtcaggggaggcttcatggagagggaatgcagtggatgtaggatgtgagcagcatctgggcccatagacaagggcaggagggacacagcgttcaggccagggaactccaagaggagtctagaggcagggaagcacagggcttatatgtagatgaggttttatcctctgaataagagtcctctggagagtgaagaaaggcacgacgacaaattatgctgggacaatcgacataataaaccagggctgtccagaaagcccagacactgcaggtcctcctacctatgtagggatcagcaagcagttgggtctatttgtaagtctgggttgtgaaggacctcgaatgctagacaaaggaatttgaacttattctgaaggaaaagggaagccattgaatatctcccttaaagtaagagagtaatataatcaggtcataggtagagatgggactcaagggagtgagactggtggcagtgagggcagcaggtaaaaacaggatgaagcctgacctggcccagtggagccagagaggaaggcaaagactgagacatagcagccaagacgagggagccatttggagaagggagcagatggcgtgagtgacaggtgggctgaggcacaagtttgggaagcctgcacacaatgagaacaatttctctctgctcataccccagttagatccctcagaggatctagctcaggccctgcctggccacagagggacacacccagtggcttcgcaggaacaggtcccacagtcatgcgtggctgagaccagctacttccctagagtcctcccgtgttgctgctcccagctggagtgacttcctgggcaccactgctgagtcagatgtccttgtcctgaaggacacagggtgggatggcccagcgacaggtctttcttttatttaataggaactgctcagggctgcaccaccccaggaacctcctctcatgtaaccagagcagcaggacatagattcatgtcatagcaacataataacaacatccaaatgctttacaagtacggcagcaaccctctatggcagatactgtgaccatcctcattttatacttgaaaagactgaagcagagaaacctcagtaaggggcccaaggtcacacagcgaatgaaggttggagccaggattagaactcgggcaatgtgctcctgctacaacatggggggccggggcggggctctgtatgcttcaggacttcaaagtggccaagagagagccagacctgggcctgtgccccgctccgccactaacgcttttactttctgagactctgcatcttcatctgggagacaggatatttatagggttgctgggtggatttaatgagacaaagcaggttttcctaaagtatgttttgtcaaatactagctccatgggagttgaacaggtattttttgagaaaaataaaatggagagctgtggggggaattcttcagttaaatacgtttgggaactatgtaggtaaagtgaaccagccttctccaccacaggagttaccaaagccttgattaggccaatgtgttagaaatttccaagaaagaaagatagtatgcagtagtccccaaacttgtgcgtccacagaaacctttttccacaaagcaccttgagggttcagtgatctgccaaaaatactctgaataatactgcaatgatgtgcataggatgcctggcccagaggaagccacctctaagtggtatctgtagttgccgctgcttgggtgattgctctactttacgtaggtggaacagagttggcaagaccgggggctggagagactcacctggcggacggcgcctaccacctcagctcggctggagaggcgggcagccaggcggtgcaggacagcgatgtcctccagcaacttctggtaggtttcccggtgctcacagtggtgccagagtgaagctgaggactgaacaggagtaggagcatcacctggggtcctcaaataatgttatggactaaatcagcagtccccaaccttttcggcctcagggactggtttggaagacaatttttccacaaacctggtgggggcgatggtttggggatgaaactcttccacctctgatcattagattcttataaggagggtacaacctagatccttcgcatgcacagtttacaatagggttcgtgaccctatgggaatcgaatgctgctgctgatctgacaggcggcggagctcaggaggtcatgctctcaggcagctcacctcctactgtgcagcctggttcctaacaggccatggtttggtaccggtttgcggcctggcccaggggatgcggaccactgggctaaatgtctgtgccccccacaaagtcatctgctgacttttggggggacatatcctaactcctcaatgtgatagtgaagtggggcctgggcgaggtgattaggtgaggagagtggagccccacgaatggaattagtgctcttataaaagggaccccagagagttctgttctctttccaccatgtaagatataatggaaaggtggtagtctgcaagccagagatggccctcaccagaacccgaccatgctggtgccctgatcttggccttccagcctccagaactatgagaaataaatgtttgccatttaagccacccagtctaaggccctttgttacagcaattcaaactgactaagacacacaccaagcctagactcagctctcatgaaagcagctctgggccccatccaggctgagagaagtggcctctgcagggcctgggccacagtttcttctggtgcttggagaagcccaatgtgaacacgctatccctggcgcctgaaagtaggagtcacacccaggccaccctgcccccttctgagaagctcccaaggctttggaggacctgtccacagccctgagggaaccaggcctttgggatctctgcctcagttccccccaactctctgaggaacactgtcagagtcttggctcaatttttcacttcaggagactatacttggtacctgagagaagcatgacaccctgtatggcccttggggacagtctctgctccagggattcctcacatcaggctccacaattaccgtaatggaagctttgaagttttccagttctttctcagtgttctcctctgtcaggttgcgttccctttcagcctggttaattctagattccagagtgtagctgtcatttctaaaggccaaggacagttgcacaaacacgttctgttgggaacaagggtgtgagagaggtgctgggaggagttactgcagaggacaaggctgcagctgtgctccttgcacgagcgttttgcaacggcccctggaacagccgccaaagcaccaaagcagccatgtgcaagggaaacgctcacttcacaggaaaccacaaaaaagatggtaaagcagggaccaaggtccacgctaggcccttcccagaaccggaggtccaaatgtattctaccaaaaaataagaagagaataacactttgctttttcctgaattttaagaaaataacatcctgtatctgggtttagataaactcaggccagtacagctaattgtgtaagcatctggatttatgctgggatttattgcatgaggggttttggagattttgcaggaaaatactgtattgaaagaaactccatgtgagatttaagcattgttgacgtaaagcaaacttcaatcagcatctagcccgagtattccaaatcctgtattgatagaagctttaagtagctgccaggagattaaataaggccaggtatgattctgttcggttaagctttctggaataaataaatgtttcatgctaaaattgcagcctgcatgaacagactttgaaaagataatattggtcatacatggaattcccagaacagtaggaaactactagggagaagaaatagacagatggacctcactcaggaaggaagcaatggtcttcaattttacagccatcatctgccctgagtggtagcagatttataccctgcagggttagtaaccacaggggcttctgaagttcatgtaacatggcccatggaaggcagtcatctccagaagaattgaaggtacagaattgacccaatgatgatgatgaaggcaatattgaaaactactccttattgagcatctactatatgccagcactgcttttcattctacaaattcatgtaatctcacaataaccctctggggtgggaactgttatacctgtttatgggtaaagaggccaagaccagaacggtcattaacttgttcaaggtgacacggagtaacggagccaggatttaacctcagactgtctgatttgaaagcctgttttatttccaccatgccgagagctgtgtccatatacatctgcggtcagcatttggacattaaacaaaccgcccatggcccatcttcacaaatgtcagtgggtaggcttagagctcatagcccagtgatagaaattttctgccttacccggccttggtcaagtctatgaataatgctcaatgcttaattttctataccttgattatccccttaacagcagtgtgacacaatgagttctgaattcagtgagaacacttggatctaggtcttggttttgccaactacagtatctagaaacttggtgtggttatttactcactcagttttctcctttgtgctgattcctgctccacctgcttttcagagctgctggttaggatcagctgaaaggatggctatgcgtgtgttatagactgcaagtgcaatgcctgtgtgcaagttatagatactacctgtggtagatacttcatactgtctgtcttcctctgcttatctggtccacatcagcagttctcattgtctcacctctgataagttctctttgtccgctacagaatgaaatgcagattcccctcagctcactcacaaccccgctgggacaaggaggccccagtgaggaaaccggaaggctggattgctgacagcacagcttcccggctccgctgagctggcattcttgtagctgaaaccctgaggaggccagccccctttcccactaaactaaagcttagaacttgaaatctgaccatttttcagtaattttgaaataaatttgattcaattctgcagcctcccagctggttttgtgtatctaagtcgtacatttaaagaatataaacaatccttacaggaatgtaaaatttccaactaccttctcccttttgcccaaatttgtcaaaatcttccatgaacggacgtgggaatggggatctcatggttcaagagggctggtcatgaatgttcacattaccccacagtcactctttctcatttttgtctaaaaatgtcagagctagagtctggaggaagaaatgttttgaataagcccagtcaagcacgggcactaaatttcataacacacttgagtcacttacctcaacttccttttcagtgagtggaggggcactgtgaaaaagaaaacacacaattgaactgtgtgcaacctagtcaatagacccaaaggtgactctgaatgaccagcagaccatgtgtttccaggggtggagtaagctgtgttggtgagaaggaaaagatgcaatgtccccttgcctgtgctctgtcacctgtgagatactgactcttacggcaccatgactatctctgtgactttggacaagttatttaatctctctaagccccagcgtgctcatctgcaaaatgggaatcatatcacctaccttgcagaggtattataagcactatatgtactcatgtatgtatgtgtatgtgtttgtatgcataaatatatggcatccacactcagtgggctctcgggaaatgtgaccttgaactcatagccttgctgtgagaaataagaaaatgcatgtgataaggactttataactcatacacatctaagttgccattataattgttctggggatatccacccaggtctgcaaagcctcaccctcctctgtctctgagggctgtgacaaaggtgcatgcgggccagagaataaatggtaggagagagtgaccagggttcttctccacagcaagaacttctgatggctagaatcacagagtggcaagaaagccccagccgacacagaggcatccttttgagcagctcctcgtctgtggcgttcccacagccagggctctccagctataggcagtccctgcatctgcatgtccactcgatgctgctgtggctgctgctcttgctggtaactaaagctggccccatctgaagtccacacaatgtaaataatgcacaggccctttcctgtgctggggcggggaggcctgggaggggtcctaccagcgtcacagaacttggcaacagagcatgccatcaataagcttctcaggaaacacagcttcctctcttgaacgggtgtgaagggaccccaagagcaaaggtaggggtcagccatctctgcagggggctggttctcacccctagggaatgatatgagtgccttcctgtcaggatgagaagaccccatggccatgaagtcagcggagtccagaacacgggacaaacagctgcagggatgtttgacacttacagtccttgtcacaaccccacccatcaggcccttgccttaactgtcatctacagcatacacatatgatttaaatgatttggcaaaacttgccaagtttgtttctgactcctgggtttgttgggatattatgtgaaatgcacatattttcataaattataaaccaaacatttttctatttcaatgactcacattctgcttttttgctgtagaacacacccaccttatttttattttatttatttatttttggggacagggtctcgctctgctgcccaggctggagtgcagtggcaggatcactgcagaggtggcttactacagccttgaactcctgggttcaagcaatcctcctgcctcagccaccagagtagctgggactatgggtgcatgccactatacctggctaattttttatttttattttttgtagaaacagagtttcactctgttgtccaggctggtcttaaactcttggcctcaagtgatcctcttgccttgagcctacaaagtgctaggattacaggtgtatgagccaccacacccagttagaacatacccaccttaaaaaaaaagtgggggtctggggggaaactctgaggactcagagaagtatgatttaggcagagaagccacatggtatgtctggtgtctgatgcagataactgtgccttacaaatgggcataggtacccgggggcagagctgtgagcctctaaaaggacacagcatcttttttaagtgactatttgtatatcttctctgaagaaatgtctatttaaatcctttccccattttgaaaaattggttatttatctttttattgagtgtaagccttctttatatgctctagaaacaagttccttttcagataagtgatttgcaaatatttcattctgtgggttgcctttcactttcttgacactgtttgcagcacagaagtttttattttgaggaagtactatttatttttaaaatcttgtctcttgtgtttttggtgccatatctaaaaaacccaaagacatgaagatttacttatattttttctttgaagagtcttatagtgttctctctgacatttaggtctatgatccattatgagttaatttgtgtgttttgtgtgaggtaggggtccaacttcactcttttgtatgtggctatccagttgtcccagcaccgtttgttaaaattacaatttttttcctctgtaaatcttaccaaaacccttgcatgagtggctttttgtcatttgttatttgcacatctcaaattattactttatcacagaggcctttccttgacctcctacccaatgccccactctcatgtcattctctagatgtgccctattttatggtctttctaccaactttactctttcaaatcattcatttggttacttaaatgttatttgtgctttgggaggccgaggtagaaggatcacttgaggccaggagttcaagattatcttgggcaacatagcaagaccctatctctacaaaaaaatatttgaaaacttaactagtcatgggtaaatggtgtatctgggattgaaacccatgtctcctggctcaaagcccattctctgctgccatgagcttctggtgacccttatgccttcatgaactgtgctcacctaagaaccccacctggcctttgagttgaaaacacccagcctggcctttcattattctttttgtttcgaatgcattatccctatctagacaattggactttggcccttctgggttcaagaattaagactggtgttcctctgtgtcccacctagaatccaacacaggggccactcggtacagggccttctgtaacccacatcctgattttaccttccagggagactcctgtggacccgcagtttgcgcagcagcacatcagaaatattaggcatgacatctaagccactctttgactcttcttcctcaatagctggggagagttcagaaggaagccctgaaaaaaaagtgcttacttataaaatgtctctttgaaatcacagtagtactgttggcagctagcttcaggagctttgacatttataagtatctagttctatgttaagggctttttaattgttatcttacattattctcacaatgagctagaacttagtcatcccatttcacatgtagataagccaaggctcagcaaggttaagtcacttgctcaagattacagaactagcaaatgacatggccagacctcaaggtctacctgcttcaaatgttatgttcttccctttgcttcccacagtattaagctggcaattggaagctggttggctctttggctataatgtttgggaaaaaaacctgctccttggcaggcttctcaggagacctgttgttcaattattcctcctcggataaattaaaatgttctatattatgtatcctacttagaaattaacatctgattccataccccatagataagagattttccagagtaaacctaaggttgctagatcttttacagatctcagaaacataaatgcctcctagtcaacagagacaatgaacagctttttgttttttaaacttctaaaactatcttgggtctgtgctttgaagacagaatgaacaaaccaagtattctcttttccataaatctttctcctgtttgaaaacagctcctgtgcctctctaaagcttctcttctccagactctagctccatttttccaacaagctcactgtgctccactgtggcccatggtctctagataccatcccattcctgcacacattctggtttgttgctgttacagaggcccagatgttctctaacaagatcttagcacaggaagactttggtaaatgtccctggcattgatgtttgttattcatgcagcatagattttgtgtgcctgactacgggcttacagtacacttagcattaagcaaaactctcaacctctttagttgacccaaatcagttatcctcatcctgtataatggttactttccatttgcatgtagaacttcatatttatccatgttttactctttctcctggattttaacctggtagctttccaatctgctcaatcattttccaggatcctaggctaggctagagaccaggactataggcatagttgtagccacctgaagagttaagactgggaatcatgtgaatagaaagaagtctcaccaaaggagaccatgaagagacaagaggctatctagtttggctcaaggtaaaatatgtttaaatactttgagcttgccagtaagagaatggtaggcatggattccttggtactcaaggtagccaagtaagctggaggatcatctgtcagagatgggtcagtcagcaattcttctttggatatgagattcaactagaagttctcttagctacctgttacctctctggttctgtcctggtatttatagctctctgacaaggtttctgtggtaaaccttgtgtcacccctggcatcattctacctttatgtatgtatccctaccacactcaacagagagtcaactgagtagcaagctcctgagatatctataggatgatcgaaacatatgaggtctaataatcaagtgaaatgcatatcagggtttttgcctagaaaagtttcccaaaatggtgcttgaagagtaatgccagaattggtggattctaggaaccaaccaccttcctcctgaattcaaccaaattaacaacaaaaaatttcagaacaaataaaaaatacacaagaaactctaagatacaagaaaaggcaatagtctttaaaaatagtgactagagaaagaataaaaattactaggaataaatgtagagcttccacccatgataaccctttcttcttctccaaagaatcagtactgaaaggaagatgggagagaaaaaattcttacaaagagttcaataccacagaatagagagggaaagggatggagggggcaagtaggcagttgtcagaggagattcagaaagtttccctagaatagaaggttctccattccatcttaccagcatttcgaagagagaaaaaactgcctgggctgcctgccattttgcttttcttactgatgagaagaagagaggaaaggcagaatgatcgcacagaacacagagtggattttcttgaatgatatgaagggatttacaaggaaggaagactaacggtaaagtaaataaaacacgtccctctgaaggagtgaatggcaggagacacatggaaagccccaaccaccatgttctcccccgactcctgaaaaacagtggctaaactccttggatttgccgttttttccttcctttcttagcagaggagtagccgttgggaagcattgggtcaagtctggaaaataaacctacggacagcttgtctctacaattccaacctaaattggtgaaacaatctgaaacccactactaaccacctccaaaggaataagatatgcccccgatttggtataacaaactcacgttttggactatgaacagagttacggaaaaagagaagaaaccaattctacaaacagctctatcttaacttccccttttccccaccacctaagcagtaacaaaacaaacacaaaatatacaatcctcaactaaagcactaaagggaaggctaagagatcccagctaaggtaggaaggagtcaacaaaaactaacctacaatacaatatatctagggaaagggaatcaaggtagaaatatacaaatcagaaaaaaataaaaggaaaacagatggcatggcaactatacaaaaatactatagacaaaagaggaaggaaggtagaaaggaaggaaaagggaaatgtgcaagagacagatgtcaggatggaaacatagttgcaagaaacacatcaaaaaatgcaaaagtatgcttctgtgcaaaatatataccataaatactttgactctagaaaaaataacctgaaaaaaaattaagaaattagagttgggatgagaagatcatgcaaagatggaagatgattgctatttaaggaaacaaattaaagaccaaaataaaaggactaatcaagaaattgggaaatatacaaccaaccaatttattggaaaaatgaaggaataaagcagatatagcttcaagctgaattagaggagggtggtagagattgagtaatcataacgaatgcaaagaaggaaagaaagattgaagtatatggagataaaataatggacctggagttgagactctgatgacccatctatgcattatgttgtctccgaagcagtgaacaaaacaaatggaacaaaggacatattcaaagatataacagaagaaaaatgttcctcacttgaggggaaagttgaacccttcaggttgacagaccgcatcatgttaaaaaatatatttaaatgcttcatacaaaaaaaaaaaaaaaaacccagacatctacatgggaaagtgaagattaagaggtgctggaaatcagctggtcccagctttctccataactttaaatacaggggagcaacatctacgcagttccaaggaaaacagtcaaccaagaattttgtaaccacacaagctgtccttcaagaaaagacaaaattttcaaatgtgatagaactcagggaacacagcacctctgaactctttcaggaaaattgttggaaaacaaaatccagctaaacaagacataaatcgaataaatttgggaaagggaccagtggtgaacatgaaatctttttacatttaagtctaaggctaaataactgtggaaaccatggttacagaatatggaatgtaaatgttataaccttaatgatgtacaaagaagaattcaagatgtgtagaggtagaaatggaaatgtaggaagaaatgtgaaggtgggaagatattcggccattctcatcttttcctgcaggaagtcagtaggtaccattgtagtgactacatgttcttatcttccgtattcttgatgttctgtcacttggtgccttaatcctggagtgacagcccctctcaaggctagctaattcctagaaacaactctccttcaagtgtgtctttgaaatacaaaccagccaatccagaacccacacctgtaaacatcacctttatcaaattctcacgcaccaagccaatactccccctaaatcaccccagggccagtacctgacaactacgggccaccctatagcctaggtcctgccaaaattattcaaactagccaaccctaaacatactgaggatacctaccctgcctctacctttcctttccaagaaaaccccagtaaaggcttggggccatctctcccctcaccacttctgccttctgacccaccctagcccttccccaaggggctctgtatgatgtgccacacatcctgctattagggatctgtgagtataaacctattccttcatgagaatcatttgtgggtctctgtgtcataccatacctgattaaaacaaatgccaggtccaaagtttagattaaatttaaaacctataatgcaaaaaaactacctcataatttatagatttcatgccatccccatcaagctaccaatgactttcttcacagaattggaaaaaatactttaaagttcatgtggaaccgaaaaagagcctgcattgccaagacaatcctaagccaaaagaacaaagctggaggcatcatgctgtctgacttcaaactatactacaaggctacagtaaccaaaacagcatggtactggtaccaaaacagagatatagaccaatggaacagaacaaagccctcagaaataataccacacatctacaaccatctgatctttgacaaacctgacaaaaacaagaaatggggaaaggagtcctatttaataaatggtgctgggaaaactggctagccatatgtagaaagctgaaactggattccttccttacaccttatacaaaaattaattcaagatcaattaaggacttcaatgttagacctaaaacctaaaaaccctagaagaaaacctaggcaataccattcaggacataggcatgggcaaggacttcatgtctaaaacaccaaaagcaatggcaacaaaagccaaaattgacaaatgggatctaattaaagagcttctgcacagcaaaagaaactaccatcagagtgaacaggcaacctacagaacaggagaaaatttttgcaatctactcatctgacaaagggctaatatccagaatctacaaagaactcaaacaaatttacaggaaaaaaacaaccccatcaaaaagtgggcaaaggatatgaacagacacttctcaaaagaagacatttatgcagccaacagacacatggaaaaatgctcattatcactggccatcagagaaatgcaaatcaaaaccacaatgagataccatctcaccccagttagaatggcgatcattaaaaagtcaggaaacaacaggtgctggagaggatatggagaaataggaacacttttacactgttggtgggactatgaactggttcaaccattgtggaagacagtgtggcgattcctcaaggatctagaagtagaaataccatttgacccagccatcccattactggatatatacccaaaggattataaatcatgctgttataaagacacatgcacacgtatgtttattgcagcactattcacaatagcaaagacttggaaccaacccaaatgtccatcaatgatagactggattaagaaaatgtggcacatatacaccatggaatactatgcacccataaaaaaggatgagttcatgtcctttgtagggacatggatgaagctggaaaccatcattctcagcaaactatcgcagggacaaaaaaccaaacaccgcatgttctcactcataggcgggaattgaacaatgagaacacttggacacaggaaggggaacatcacacaccggggcctgtggtggggtccgggggatgggggagggatagcattagcagatatacctaatgtaaatgacgagttaatgggtgcagcacaccaacatggcacatgtatacatatgtaacaaacttgcacgttgtgcacatgtaccttagaacttaaagtataataataaaaaaaagtatattactaagtgaaaaaagcaaggtttggaacaccttgtataatatactacgatttatgtttaaaaaatccacttttggctgggcgcggtggctctcgcctgtaatctcagccctttgggaggccgaggcgggcggatcacgaggtcaggacatcgagaccatcctggctaacgtggtgaaaccctagctctactaaaaatacaaaaaattagcccggcgtggtggcgagcgcctgtagtcccggccgaggaaggagagcggcgtgaatccgggaggtggagcttgcagtgagctgagatggcaccactgcactccagcctgggtgacagtgagactccatctcaaaaaaaaaaaaaaagaaaaatccacttttacatatatgtctatatttagaaatgcttggaatatatctagaagttacactaaaacatagtgacagtggttgcctctgctactgggggacagagatgtaatgagacttactttttcctatgtctcattttgtactttttgaattttgtactatggacatgattatttataaaaattgaattaaaactcataccaaagcaaaaacaaaaaacaaaaaacaaaaaacaaaaaactacctcagtaactccaaaccctttatgcatttcataatacattttttatacttttagaaaccaatttctcttctttggaggaagcagttaccaaaattcagcaagtcttatagtttcacttcaagttcaattaaattctaatagttttaatttcaaacaagtatatctagtataatctccctctttttcccttcctccttctgtattagtggggaaggaggtgtttagtgtaagctatttttactttcttccttgtatttttcactattggttgaatttttagatatgaacataagccactttcaacaaaaagtaataaatttattttcaaatatatctcccaggactagctcattccaatgaaaatatttgtttctgaccatgtcagggacttggaaaaattacttttggagctctgaaagatgctctgagtcccaggatggttcctaaaagtcaaagctgctagttggggataaacttttttttacctctttcttctcagggaggcctctttcctgcccaagacctgaggctctgagtctagactgggggttttggaaggactgtccattcgatgtacttctctgcctcagcctacgtgtccctcaaaatccaggtccagatagccaactaccttctagacgttgccacctggttaaggagaataaaaatcatttcaagagccaccatttactgaacatcaactatgcagtagatacactttgtcatttcttacaatagtactgcaaataaaaaatagcttaaacacctccttccccacaaatacagaaggagcaagggaaaaagagggagattatactagatatacttttttgaaattaaaagtattagagtttaattgaacttgaagtgaagtgaaactgtaggacctgctgaattttggtaattgcttcctccaaagaagagaaattggtttctgaaagtacaaagaatgtattatgaaatgcattttctggagaaactgaagctcagctgagttaaagtgatttactagggtccagcttatcagcagtacagccagaatgcaaaaccaggtttgtctgttgcattcaagctgctttccgtgggcatttgacatgtccaaactcaaattcactgtcttccttctcaagcaaactcctcctcctgtctcacaattcatcaccctcacaaccatgcagacaggtgcctggtggtattcctggtctgcctctcaactccatctcctcatcaagtcctgacaagctgatctccaatagctgtcaaactatcctgtccacatttactaccacctcattacctctcaccaggctatttccctatccttttacctggtgtctccctgtctctagcctctgctgtttcaggccagctctcacaatctgtccagaagaattattctaaaatatagatttgatcctgatgcttccttacctgcaggcttctctttccaaagtgtcctaaatgaaattcaaactcattaattggccttcaaagccttcaatttccttggtctcagcccactgttcccaccttgttgcccatctctctgggacgtgtagctcacacttagttcacatgacattccttctgttcctgaagtatgccaagcactagaagatgcctacatgcttttgcttctgctgtccccctgcttgggatgactttctcttccccagctcaaggtggctcctcctgaaaaccttccctgactcaaccccactgagctagctgcttcttcctctttgttcccaggtactttatggcctgttaaagttttatcacaatttatcgtagtgactttgtctattcttatgtttcctctcctagacagtgagcttattcgttcatacatttgtttaatgtttattgagtgtttactatgtccctggcaatgagctgggagctaaggatacaatgctaagcaaaactgacatgccacatcctctggagctcattattcaggggaacagagattaatcagagaaacatccaaacaatttcacactgagagattttacaaaggagaagggatccgaaggtaccagcaaacccttcccaagaaaagtgacatgagcagatatctaaagattgagttgggagttcattaggcaaagagggagagaggaagaacattccatgcagaagacagaatgtgccatgcgtaagaagaggaaagaatgagctgccgaaggcaggccaaaatattgtgagtgagagtgagtgtggccctagaatatgctggggaagtgggtggggttaactattcagggccttgtaggttctactgaggattcaagtgctcttcctaagagcagaatgaagcctctgaagatgctgaaacagatttgccttctagagatccctgcggctgctgtgttggccatggtgtgagctgggttgggggttgggagtgcagggagaggggaccaggttgcaggctgttgagttagccaaggggactgataatggtagctgggacaaggccttctccctgatggtggggcctgaacccttttcacttaatgcatccccagcacacagcctaagaactggcccacagtcagtctcacatatttggcttgaaataacctgcaactgatcaaagatcaaaacagcatacaatatagttcctgagaagggaactgattgggttgttggaaagactagatgcagcacagaaatgagcctcccagtcctcacaaactgaaggagagccaaaattcttcagactccagaatgttctgataagtatcttttcccatttctcaaaggaacagccaacaaccatcataagagactggatttttccccatgagttcatatgcagggctgtatttagtgcctataaatacaatctgagccagctctcataaaatgctcccaaagccttttatcctgggtatgggaggggacggggctctttgatggggctttcagaatataagaaaagaaagtcacaagtctgcaagtattcattaaacacggagggttgcccaccacatctctagcactgtggagcacagtgtacaagaatatcccatttggttggcaagatagagttctacaacctaaatgacagaaatgaaaatgtatgccaggttcctgctggaataaagaccagtatcacatgcaaacattacagcagcttagtgaagtaggtactgttattaacctcctttaaaagatgaacaaactgaagcgtggagagaattagaaccttgaccaaggctatgcagctggtaagtgatgaagtctgagctcttaagcatccagaccctagaactgagagaaaatgagagggagtgtatattgttggacactgaccatggttaattttatttttaaaatttggtgcttataggagtcacattcatttgcctgataattttacttctaagatccatcttatgccctattaatattggataataaagttttgctgtaggtagtggatgtctaaattggtataattttgtaagctaatctggcagtgtgcacatatacatttaaaagtaaatacttttaaccaatcaattgcaagtctagaatagtagcccatggaaaaaacagatttctataaagatctatgtaagatagtattcattataacagtgtttttaatagagaaaaaaagtggaaatattattacaactggggagaagtagtatttttataatgattgaaataatagaagacttctcaaagggaaagataggcaaacatgattatgtaaaatctttacaattcctctaaaataacacaaaacgtattaaaaagcaaaaaaaagattgaatgaaaatatattaaaatacagccccccccaaaagaaagaaagccaattaagggctaatatctataatgtatcaagtttacatatattaccaacaaaaaccaaacaaatcaacgaaaaaccccagacctaaatgggtacacgggcaaagatgtaagaagttaagtcacccagtaagaaaacaaagtgactattttaacattttaagtttgagcttcctagcaaattaattgaaataataatgaaatttcacactaataataataaacttaaaacaatgacaattattgattattcttactatattctgaataataaggagcagaagcaaacaccagcacgggtaatgcgtaagagaaagatgtccattcagtctttgtcagtagcgttattcattgtaagtaatttgggaaatgcaaatgtttctactctttaaccttgtgattctcaagtctgaacacttatctcaagggaatgatttaaaggaagaaaaaagaacaactaacggtccataattgtttatactagcattgttaatcctagttcaaagaacaatagataggtcaatacaagaggaactatgcacccattaaatcataactgaggagaaattgctgagtataaaataacaagtaaaaaaaagaagctgtatctattcatcaaatcaactgaaaacattataaatatgggcaaatattgcaaagaagaaaaattgttagtttttcagaattgatggggttgtgggtgaaattttaaagtgttttttccagtgttttaaatatgctttagtaaatttaaaattataattagagaagtatatgctgcattttcaaaagatctctttaaagatggttatttaaaatattttgcccttgggaaaaaacactgtttgaaattttacttctgggaaccttcttattaatgctgaataaataggtaggtgtaagttactacagttcagaccaggggcttccaccattgttagtgacatcctggacacattcacccaagaatccatagggctcttatgctgagactggcccccagcagcttgaagcggggcaaggattttcaaatggtgctctgtgaagcctgggtccctggaggtaccttgggcccacagtctcagaagatgaaggatccaagcccttctatccccttcaaccagagcagccccatttgcatctccccaacacgctggcctcctacagatcagcttgtctgaaatgttgtgcagcttaaaaaaagttttaaaactgttcatgagatggccaaaccatgagatttggagtcaggagatcctcgggcctcagtttcctcaactataagagcaagaatccctgcccctcttagctgactgggaagattacataaaatcagaggtaacaaaatggtttatactgtggaaaatgctatgggaagtttattaattaagattgaattaaaaggactaggtgacacggatgaaccttgaagatgttttactaattgaaatgagctcgacacaaaaggacagatactgtatgattccatttctaggagggatctagaagagtcaaatacatagagacagaaagtagaaggtgatcaccaggggctggggagggagggaataaagagttattgttttaatgagtatggcatttcagtttgcaatgatgaaaacgttctagaaatggatagtggtgatggcttcataatatgaatgtacttactgccactgaactgtatacttaaaaatggctaaaatggcaagttgaatgttatatatatttacaataaaaaatagtcccccaccccctctgaaaaagggagtactatatagagtaaaatacaaaagaaagtcaagaaagtagaagattgcagagctggtgggactaacccactgctttaaggaacaggtaccatatgactcagagaggagggagatagcccagcaggagggagatgccgcggggacagaggcacagaggctagagggtgagtggccacagagaagaggctctgggaagagggaagagccaggagcctggcctgttggaaacactcatctctctccactcacccatgcctctttgcccacctcatggcactatggttacagttacaaattattttcatgtacctatctcaatgctcctgccacatctttttaaaaatgtttcttttgagacaggatctcactctgtaccccagagcgagaccctagagtacagtggcacgatcacagttcactgcagccttgacctcccaggctcaagcgatcctcccacctcagcctcccgggtagctgggactacaggtgtgtgtcaccatgcccaggtaatttttgtattttttgtagagatggggcttcgtcatgctgcccagactggtctcaaagtcctcagctcaagcaagccacctccctcccaaagtgctgggattacaggttcacctagccccctgccacatctcatacaatttcattcgttcattcaacaaatacctatgcaggccctagtagtgccaggcattgttgtaagcagtggacacacacacacacacacacacacactcctgcccttgggggcttcttctctagggataatagctgacacctagataacacctgtcatgtaccaggtattgttttaggtactttatagatattagctgctttaatctccataatcacctaagaaggcaggtactgttcttagcctggttttacatgcccagggaggttgaatagcttgcccaggtcacctgagtggtagcagggcttacagttccaactcgtggtggggctcgacatactcatgcaggagaatggggccgaggaagggtgttgggggcactgggagcagggctggacttgcccagctagatctagaggggtcagaaccctactgagaacatcggcagaggtgagtgcagagagggaggcagtgcgggggctgaagcctcattttcagaaccattttccccgccatggttctggcagaaggtggacagggaaccagaggcttggaggaaggggcctgcagctacccagcagggcagggctggggtatggactttgtggtgacagcagattagtaagcaagagatggccgtgatgccttgaaaagaggaactcttcagtttgggcagcttcctgggtgtacgaggaaaaggaagtgtcaaaagttcaggcctgaggcacccttccaggcccactagatgccagcatggcttagggagggctgacagcgaggcctgggggctggttggaaggaggcaggtttggaggtgctgagcgggcagaagacacaatcggattcattcattcaccagcaaatgtttcctgaggaagacacaggaagtcttgtgtttacacattcaccttccttgatctggcacagacaaatcagcactcgctgagacagcatctgccccaaccccacctacctttttcctgctcagctgcttcactaaggtctggaagcttgagccccactaagttctgatttctcatcaggatgtgctcctttgtggtaaaagaaagagataacaatttcagatgatgacactgggctgggctgttctcttggctctgtctatggttctgcgaccactatcttaggtgggaaagcggggcagcctgagaggtgggtgggcaggcatggcatggtgaggcctgagaagcaccaggaaatagttcctctcccagtccgtgaaggtgcctgaaacgccactgtcagcaccactttccatgggtcagggactacccttggcatggtctttttaaacaagtctgtgggcttcagggtaaatgaactgcttggcctcactgtggctgaggtttgcaaaggacacacaggggcagaactaagggctctgggacaggagggtcccctgggtgtgtatggcgctgctcctggaaacagctttggcgatctcatggctggctggatcttcctgccctgtcattccgggcagtgactgctcacttccaggagctgcgattgccccacacactcaggtcatcaatggccttttatggcacctcttgagtttttaaactctccagaaaagtgaggcctgagaattgctggcttagggcctcagctggcagagcccggggagagatgggatgtggcccaagtgggctcacacctgctctaagccaattagcaccagaccaaggacctgagtggaggcacctggcagagctccttgcccctgtgacttatggatcttcagtctgctgtgtggcagagggcacttgggaatggtttgtcccccgagaagggaggaaaggaaggggccagcagagggtgctcatgatccaagtggaagtcatggtcaaggaccctttacccatttggttagcaagccagaggcccacagcccatcagcttcagcacactggagtcgggtaggggctgggcactcaggtgccagggtagtggttagtgacatggggcctccaggttccctgtaacttctctgggtgggcgaaatctgcaggagtgtagggagtgaggaggctctgataaccagaggcccatgaaggcaaatccctggctatcggccccttggctccaacttccgctagagatccgggactgtggcaactcctctgggccctgtgctgtttgatccgctagttagttgggtctttctgactaggaggagttttgtgtgtaaaatgttaacatcagcagccacgccccagctcccctgtgcctccagttcagagcatcatgaaggtatctgaataggatagtggccagcattggaatgtgtccctgccagcacacaaatcccctcaattgtgcttgagtgctatcgggcaccttcttttcttccctgccccacatttccctctgtagaggagccaggagaagcctcctgctctgagggtgctgggcctcactctgtggaatccaggtgccttggtttatattccaagtgggccttctggaggagacaggactggtcagaattgctttgtcctgttatctggtctctatctctggatgcccccaatcataccctgcatagggtggcaaccccacaggagaccgctgtgcctggtttgatggccaacagaagctgaggggacaccatgggcactggaagaaactcaccatgggcggagcagccttcacacttgcagatggacttaaagcttttgttaacaggcatcaggaaggaaggcttgggggcatcacaaaggaaatcactatttcacccttgctagctaatcctaggcatgactgggcactccatcaagggattcctgtttatgagccactgactccggttggaggaggaaagcagcccaggactgaggggcccacatgtccctccacacgtctgccttcccctgagatgtggctttgtgtggcaactagattttagactgagctctgcctggtaactggcataaaaaagcacctaaaactggtatttaggaaagagatgccacataaataggcctgacttctcagagtgggaaaatttacgccctcacaaggcccaagtccaggccagagctgccctggccaggggcccagactcagccctgaggtcttcagcccagggagtacctggagtacacactctgcccaactggcccccaggaacccacctctcggagcttggtcagtttctgcatccgcacgggctgcacttgtatctgaaagtctttgagaccaggggccttggccagcttgccgccggccttgcctgcaaaacgcttttcttcctctgccagtggcagcttggcaagcactttctgcagccgggggccaggttcttcagggccactgtcccaggagagccctcgcagcagcgggggccgggacacagtgggtggaagctcagctttggagccagcctcgggccccatcggctctccagctgggcctctcccctgggaggctgggggacccactcctgccgcatcctgggttggacttctcggcagagggctgccctcccagcccgttttcaagagctgcttccccagctcgctctccacggggccaggctgagggctgttcagggccattttcccactgctgtttgtaacaggagctaggcctttgggtgtggtctcggggtactggaggggatcgaagttttccttttgttctattgcaatctctttggacttctcaactggaggaggacgaggagccagcctgccctgagacactttcctctggtcattctgcttcctgtcagctagccctttggggacgttctgaaaaagacaaggtagagctggaaccctcgggggcaggttgaggggaaacaggtgaggccacttctgctgtggagtctctgcccccacacaccttgccaaggggcccatttgtataagtgtgtatggggtatgagtggacgatgtggaaggagagggcttctgcccgaggtttgtcaaacagacaggaaaatggaacctgcaatccaaaaccagccaagaatttcccaagggataggagctgaggaaaactgaatagaaggcagctttggccctaactcagttgccccagatctagccttggtgctgcttagcaaggcccttaactcttagggacccaggtttgtgaaccctctgaaattatgtatgtgtatgtctgtgtgtggaggggtgtttttctaggaaaaacatccacagctttcaacaatttctcagagttccatgatccaaagaggttagggatcattggatggggtgattcttgcaaaggtgatgtcttcctgctcagaagctctaagattctgcagtgttagtttactttgttcattccccaagggaaacctgggccgtgagcagcacgtgggtctgggggtctgtgtggctgcctcgtgtgtgctgagactcttccagaggactgtatcccagacccagttccaggtgacactaaattctactgctgcccttgaaacactgagcacgtgggcccctcgatgtgagcagggtggggcgcttctgttgctcatcaacaaagatgaggttttcccggcttccccagacagaatcccaggcaggggctggcgctttcctgcccttttcactggagctgacaggagccacagtctcacctggcctggaggtcccccttgtctccaaccagcagcctgactgggggtcagcgctgtgagtattgcctccacggagttcacccccctgaatcctgcctccccacccctccaccttagacttctagtcactataaggcaggggaatctgctgtttccccagccctgaccctccactcatacgtgtgcatgcacacacacttgaaggctgcccaggagccagcctaggcttctaggagactgtgccccccacactcaaatcatccaaagggagcaaagctcaaactcacaggctcgccagggtgaggtgaagagacgtcggcctcatcccccttctgctggagaaggtgaacaggagtcagtcagcaatgggaagagaccgtgtttcctcttgaaatatccccaaggaggccccctagcagtggtgttcatgccctccacccagcaccctcatctccagtgggtcacgaagggcctcctggtgttcggggtaaggggagagacccattggcatagaaacagcacagcaggtggggggtcctgtcacctgtggtggtgctccaggcagaggggatggcgggccactgcacacatccaaacctggaagggtccagacactagtgagtgaggcccagcagcccaggccctcagctgtgctttcagccacatctccctccccgggctatcctccctttgcaatctcaggcctggaagatttgctgactacctcccgtgtgccaggttctcaggtgggccctcacagaatgttcacagagaccacaggaggaaactgaggcacagggaaatcaaagtctcatggccaggaaatgtcagcactgagatttgggcccaggctgcctggccccgacctgagcgtgccctgccgcactgatgagggccggttgcccttcctggcaccctccccctttccttgttggctggagggtgtgactctgggtacagcctaatgaaagggaagaagtcagaccccaaagaggcctttctgtataagctcttgagggcttctctgagcctccctgagccagagaggctgtcctagtcccctttcccacccagccttcctgaccctggggtacacctgcctcccgacacaagcccaagatgctaacagaaagtctatctgcctcctctgggtggcccagcaaatgccccccctggagaggggtcttgctctgggtgtgaaggggccatcagagttcttgaaggggaagcctgcaggctgggaggcatgctgatctgtccaggctgagctgccacccagagcgagaggcagggcaggaagtccccgggcagctgggcctcacctggcggggtggggactgtaagtgagttgctccgagaggatgtaggagaagcgctggggctgaggttcggggaaacagctgtgaagacagacacaaattggctggcattcatgaaggtttaggacttcaacctggcaaaggcatccttttaggtattcccaggccctgggaactgggtctgccttgctgggctcaggggctgatgctggactgcaatatgatgctcctgttacagcccaacccctccctgctgctgctcaagagatgggtgccctcaggccatttgggggttcgaggatagagtcacacttctcagcctgcctggcctgacctcaaggcactgtccagaaactgaggcctggcgttggttggcaggtacagctccagaggctgctccttctcgacttcccagggtggccctgacttcaaaagctccccttgtcctcctaagtacacttacacacttgcccaactttttgctcaggaagaaaagtgactctagcatagaggaagcaggaggatttctgggcccaggaaaaccttccctctaacccagaaattccccaaagaccatctcctcttccccagagggcctaggatccttcccagcacccacagagatcaagggaagggagcccaggacagaatcctgacctctgctgaggagagcaggtgagtccaaggcgacctcctcggaggtgaggcgcccactgcagctggtgccaggcccttccctcccgaccctagaggggctcagggcagccacctgtacatcctgccaccctacctgatggggagtctccggggctgctcctggacttcctcccacggcgggtcaggaatcgctcactcaccaacttggcttcttccagcagcgccaggtttttcttcttgtcctcctctgagatgctgatgtctggcagctggtcattcaccaggtcaatgatgtgccccgcggggtctgcagaaggaggatgagctggggtgagagccactgcatccgtggccccaggctgaggtcatgccataccatgcctcatcccagggactctgcccacagctgacccagccagccaaacctcagcccagtgccatcaagagggttgcatggggacagacagtggcttcctctgcaggcctggcccctatggcttatggcctgtggtcctccgtcacaaatggtcctggagccatctcaggttcccagaattttcctaaactctgtcaggaagggaaggccacccaggagccttacctccggcaccatctgcgcccccagtgcattcttgcttctggcctgtttctttcacaagctaatgcgcttaaggtttgtgaataaaagaaggagaccaaagatcattggccacggccacaaccccgtggccaccttccctccagtcacattgttcaccccatttttctccaaaactgcccctctggatgaggtgggtgaacggcaccacctctcacctggctgctcaggatcacaggagtcactccccacttctccctcttcctccctcccccaacatccaatcagttgatcaagtcctccctgcatttacctataaacatctctggagcctgttcctcatctccattcttgctcattagctcttttttttttttttctttttttgagacagagtctcactctgtggcccaggctggagtgcagtggcacaatctcggctcactgcaacctctgcctcctgggttcaagtgattctcctgcctcagcctcgctcgtacttgttagctctttcctggacaattatgtcttctacctaagaggtccctgccctcaggcgagctcctccatcccatcccccactgcctatcagagtggctatcagagccacatctggccatgccattctccacctcatctcatggggatttctcatgctcctcagtgtggtatccaaaccctaaactgggctcagccagtcttgctggcccccacatactcctcccaagtccctccacttcagctgtgtctgcagtgaacagctcccatttcacctccatcgggttccattcgtctttgggcagcagatccttggttttcacttggtaaaaacctctctgattccccattagctaacccccctcccctgtgccaagagtgggaatgtggactagtcttggccaatcaatgaacagaatccccttggccacagggattggctcggggatggccatgtgaagccattgaggggcaatcctggtgtggagtatatggggaagaagaactctccactgatggggcgtaagcttggagttgctggtagctattggctaccatgtgttgaagagtctgccaagaagaaagctaacacacaagaaaaaaggttcaagagatggaatgggacaattgctaataacccactttgagcacctggatccagcactacctgaaatcacaagccctggcttttgtaaatttttttttggtgtgaggtagtttgagttgggtttctatcatttgaaaaagtcccaattggtacacatggcagagtttcagttgccagcaacatgctccagggaggttcctgctctttcagtgtgtttcctattccccctggaatgcctttcctccctcgcctatctgtccagctctctaaggcacaactcaaatgccacctcctctggaataccttcctaaaacttcctctcctcagagagactcggtccccttcttgccttggctggcctagctcttctgtgcagtctcttatcatacagtgtcccaattatctgttcatttctcagtctcttcatagtctatgagcagcatgaaggcagggaccaactctatatgagatctatgttccaacagcccagggcagatcgtgagccaccatctggggatgagcagatgaccagggcagccggccttacactcaggcacctactccaacctggatgtgggcctctttagcagaggctggaggactctgccccctaaaccccagaaatgagtttcactcagctgttctttctttctttgacttctgcatcttcctcttcatgccctggtcttgtcttttgagcaatgaaaactgaattaaatatgcttctcctagacccagacacggaggggctgatctaccctgtcctgttggacttatcgggagggagcgccttaaagagcaggagagaggaaggagtcaagcccagccacgctgccagacctgtctttctactcaacatgccttagattgccctggtccttacccacagatgtcagggaggcagtggacaccttcaagtgtcggtgagaaagcctcttgtggggactgtgaactctgaaagacagaacagtcatcttgttcagaaaatcaatccacaacttgaaaataggtgaaaagatgcctgtatattctttttctttttctttctttctttctttgtttccttctttccttctttctttctttttttttttttttgactcagttttactctgtcacccaggctggagtgcagtggcgcaatctcagctcactgcagcctctgcctcccaggttcaagcaattctcctgcctcagcctcccaagtatctgagactacaggcatgtgccaccacacccagctaatttttgtatttttagtggagatggggtttcaccatgtcagccaggctggtcttgaactcctgacctcaggtgatctgcccgccttggcctcccaaagtgctgggattacaggtatgagccactgtgcccagccagatgcctgtatattctttcaaagtcatcctagaacatcatcttacaagcttctcgagggtttctctgactctcaacttgggaacgtcttagaaatgcaaattctcaggccccaactcagatcagaaattctggaggtgggcccagccagctatgattttacagctctccaggtgattctgacgcgtgctaaagttttccaaccactgccctaagaggatgtgactttgacttactatttcctactcattaggtcccagactctgagctaacatctaacttgtagaagcctcataaaatgtaaatcattgttgtctgacaaagacgcagatgatttctgtttgggaaaaaagacaaaaatatggtttcattgccctgtagaacattcacctattttatatctaacttagcagttttattccagcactttcctccccactgatgatatatgtatatccattgcttgtatcctcctttgaaccggctttgttatccagatgcttcttgtattaatgaggtaagtaaatctttgacatatgctcagtatatttatatgagaattatctttttccttttctttttctttctttctttttttttttttttttgagacggagtctcgcactgtcgcccaggctggagtgcagtggcgcgatctgggctcactgcaagctccgcctcccgggttcacgccattctcctgcctcagcctcccgagtagctgggactacaggcgcccgccaccacacccggctaatttttctgtatttgtagtagagacgtggtttcactgtgttagccaggatggtctcgatctcctgacctcatgattcacccgccttggcctcccaaagtgctaggattacaggcatgagccactgcgcccggccgagaattatctttttaactttttgaaaattagacagtctcatttcagcgagcccagttcgtgggctagtgctctgtgaaaccaaggcggagacattcctctacctgtgagcccatgtccctgccaagagatcatatttcacacgttttggccaggggcaggattctacattcaaacacctgcacctttcatgtttggctgcaaatagctggacagttattatgggaaactctcctgcggtgatttatgcttttcttaaaggctagccctttccatgggggaacaagtccttctggggcccctgggcattaaatgttttaacctccactagccctgctgggggaggaggctgcaaatgggctggagccgtcgcagagccaaaaggaccacatccaggagaggaaaaatcattttaggaggaagataatggaaaaattcctatttctatcttgtattttgaaaaactgcttgattatagtttagtcaataaaatgatacaagaaaaaagaaaagatttatttaaaaatatagctgtctgatcctcatgttctaggaaatattgtttgtcacaatgcaaggatcaggcacctgtacctgttggccaggtttttgtcggtttctccttctggtgaagtggcatccccagtcaggacaatcgtgggagttggactgcaagatactcctgcggcaggaggaccctgccggtttagaacaaaaacacagagttaggcttgggctggtgggacttccagggacaggagccagagcatttattctcacatcatgatgctcagagccatcttgataaggggacaaatgcagtttactctttattcccccagctttattgaggtatagttgacaaataaacattgtatatattcaaggcacacaatgcgatgttttcattaccttgatacaatgttttgatacaatgtgacatattcacggcatacagtgtgatgttttgatgtgaaatgattaccacagtcaggctaactaatatatccaccaactcacatagttacctttttgtgtggtggacaatacttagcaaattccaagtatacaatacattattaactacagtcaccgtgctgtacgttagatccccagaacgtattcacctcataaccaaaatagtaagttgaattctttgaccaacatctccccatttctcccacccccagtcactggcaaccaccattctactctctgtttctgcaagtttgaccttttaagattctacatataagtgagatcatgcagtattgtctttctgtgcctggcttatttcacttagcatagtgtcctgcaggctcacccacattgttgcaaaaggtgagatttccttctttttttaaggatgaataatattcttgtgtgtgtgtgtgtgtgtgtgtgtgtgtgtgtatacagacacaatattttattgtgtatatatttttcacattttttaattcatccattgacagacatttagattgtttccataccttgtctattgtgaatagtgcacacatataggttatttggattactcagaaaacaaaaaaggcagtttctcctttattccccagcaggccctcacctgagcttaacacggtccactattcatgcactaagattagggacactacaagctatccctggttagttctcactagcaatgcaggaaaagaatggtacagagtcctcagattgaggccagcctggctggggaagaatgatggcctggggaaaaggtagtggcacccacacacccctgaggttccacgacagtcctacctttgggtaactttgacatttcagtgatcgtaatttgttagaagactctcctggggttttctcttaggtccttccatcaacttaagagggtgcctgtcattttccttctcctccttcccacccccttgactggcatgtgctgccactgctccctctgtgagcacctgactgcctttgccaaaggcctgcctcctagcgtcccagagcatgttgctgccacctccactattggtgctgcctcccgcagcttcaaagcagtgggtgcccactgtctctattgccactttccctggtgggccaaatccttctagagcccctgcatatgaaatgttttcacctccactagccccactggcggtgggagctgccaatgggctggagcctctggcagagccaggctgtgttcttgagccttcagtgtgcaggtgttggttccctgcaaggtagggaggaggcctgctctccttttgacattatgccttgttgtgaaatgggtctcatacagtgctatctggacttcttacgtcccacaatttttagtgaacccagcttttcccattttcattttcatctcttcccttctttggccccaagcataaggccacatgagctggagaagtctctgggtgagagtccagctggggagcaccatgctgcttctcttgtggaaaggatgcttttatgtggaaacccagagccagatccttgaggagatgttcattgggctctgtgttcttatccgggagcgattcagtgcagaaagctacagtggctgaaggaagaggaggcactcagaatctcccgggacatggaagggaagcttgggcagggacgtgggctgtgtagaagcagaaggaagcagcattgcctattggaagggtcagacaaacctgggctcaaatttcaactactagctatgtgtcgtggacaagttatttaacctctctatgatccatgattataaagtctaactcacaaggttagtgtgaagattaaaaataacattgataaggtacctatgcatgattgacatttttatttatttaatttatttagtttcttcagtgcagtggcacaatcatagctcgttgtagcctctgcctcctgggctcaagtgattgccctggttcagcctcctgagtagttgggactacaggtgtgcaccaccacgcctggctgacttaaaaattttttttttagagacagggtcttactatgttggccaggctggtcttgaacttccagaatcaagcgatcttcccacgtctgcctctgaaggtgctgggattaaaggtgtgagccacgatgccaggccatgattgatattctaaatgtgctaagcatctagcatatgattaatgttttaaataaatgtgtacattactttagatttctttctctttcaacaaacactttatggttatccaccatgtgccaaaagcaacttgagatatgaagagaagaccctaaagggctcgcagtcaagcaagggatacagggaagtaactcataataaatataaggaaacaagggatggaccacattctgtgaaagctcagaggaaggaaaagaaaactctttagtgaggggagttaaagaagactctatagaggagtggacatttgagctaggtcttgaaggatgaataggagcttgcacgacaaagatgttagaggacaggatttggccaaagggaatcgcattagcaaaaggcattactgggaatcagggatttgtcagtgtagctggtgcaggtgcatggactatgacatgtgagataggagaggtcagggctgggggaattgtgaaagtacaataagagattgagccagcttctgaaggacctcgaagctactctaatgagtttggtctttatggttttggagatgggaagccctgaaggttaggcttgagaataacttaactacccaaagggaaatacagaaatgttgacagcagatcatccatgcatccctctattcacactggttgagatgacagaagaggcccagttattagaacatctatcatcccctataggaattctgaggagctccctggtaaataggagctgtgtctccatttggaaacctagagctggccaagagggagtgacaagaagtcagcacgtgcttgtggctgaaaccaagactggctgacctgtcctcatgatcccagagctccagtccctctgaggacacagatacccatccttctgtcaaggactccccctagaagagacacccagggagttttctgaaaagcaacaactcattctctggatagtatgccttgatgggctggtgataagcttgtcctcctgtggctttatccctccgttcctataatggcacaatggccaaaggcctgctctctctcacaggaagattatgcaagtaaaaagaaatgacgaatgtgtatgcactttgataagtgtcatatggtctacaagtacccttgagtcatgattattattaaaatgaatgatggctctattcaaggtgagccagtttttcccatcttttgttcagtgggctcccctggtgggaggccagcaagcagcagaggctggggtttccaggggaccagaagagaagtggaacaatgatctggggccccgaggacatgcagtggaacagtattcacaagggctggggaggttaagaaggggaagcagtgtgtcaaatggcaggtagccagatagagggggcagcaggcagggccaggggcaggtgccaagctaaatgggagagccagggaagaagaaggaatagggagttttctactgtgtgggttttctggtgagtaggaagagctgaagtctttccagaggaatctcttcacatcattaaaaaggagtagcattagcaaaaggcattactgggaatcagggatttgtcagtgtttctggcaggtgtgatctcttggatgtcaattaagcaatcagcatcctctgatgcatattctgagctcagaggtgcaaattagagacccatgtgcctgtttgctagtagtgtttacaagtttttaaattagttatcaacattccataattgtaagaattcacataaaggtctggatagcctgcttttccttaaactgaaagatcaaacaatcttaggcccatatttctgcagagtaaccaggtttgagctatcctaaattggctttcttcagtgatttgtgctccctggccccaaatgcatctgagttactgccctgtgtcatgtagttttcatcctggcctggttttccagagcacaggaggtttgtgcttaaaatctctcccacccacatcatctgggcagcctcatgcctatcaccatgggaacgccaatggaaactctgactgtgcttatagcatgcgcgggcttctttccctggattttattctgactgtgaaaatttgagctctgaaagttgcctttttcatgtctgtcatatttagagaatttctttcttgtatgagtcctctgatgaacaagaagaaatgcattttgtctaaaatatcattttttacatgcattctatcatatggtttccaccaccccttgtggtggggctttacaaattcctggcatgcattgatgaggataagctgtgtctatttaaaggggcaggatgggccaaacatgagctaattccatgttgtattctgaaaaaataattgtggtggtattaggagagttatagcatatatccatttctaacagtttcatatattcaggctgctaaataagtaaaatacatattttattttatttttatgtattgttttgagatggaggctcactctgtctcccaggctggagtgcagtgatatgatcttggctcactgcaacctccgcctcccggtcaagcaattctcatgcctcagcctcccgagtagctgggactacaggcatgcaccaccatgcccagctaatttttgtatttttagtagagatggggtttcaccacattggtcaggctggtctccaactcctggcctaaagtaatctgcctgccttggcctcccaaagtgctgggattacaggcgtgagccaccatgcctggcctttgtttatttttaatcttattgacactatctacttctcaaagcaacttgaagtaaccaacaataaaatataagatataaaaacatgagactatataaatgggggaatgatggatgatttgacaaacataaatatccctagcagacaaggagaacctcatgctcctaacagtctatggttgggagttgtggttaaactatttgccctgaaacctaatgaagccgtgatccacgtggcgcagactctgagaaggctcgccttacggaactgttcaacagaaagaaaaccagcatagaaggaacttcattctttactctcacctctcaaagaacatgaaaggggaacaaatcttcactcccatcctgacctctcctctgcccttttctctttccttaacgattctcacgccccctctctgatgactcttcccctgcttgcctccctgcccagatcctctgtctaccttctttctctttttctcctgctccagcctttactcccccagctccatccagttattttttgtgcagattgtcttcatttgtttgtatgattgactcacaaacatttactgaagagtcttacagagcaaagaccttcttggagaagagaggggcactgggctggcaatgatcagattctgtttggcgtccaagaaagggatgtggtctgtgaacactcccacattattggaccttattctgtccaatcatccggcaaacatttattgaatgcctattgtggccagggtctatgctaaggtctgggaagacaaaggtgaactgagcgggcctctgcaatgcttcccattcattagcatgaaggaatggggagagaaggggaagtaacctccactgctattactaatagtgccctcggtgttgatacctaccaggtaaatgggtacaaggcacgggagtgagctgccttctgataggagctttctctgcttgctggctaatggttacctgaagcaaagctctcctgactgtaggcatctcactggggaggaggaccatggcagaggtgcccatacaaaaaggcagaaacaagccatgggtggcaagtgccaagcaggtaaccgcagacactcacaattccaagtggcttacaaagcaggaagcataaagcgattaggaggaaatcctctaatcccttgatggaacatcctggaaggttcttcacacttgccttctaatgtgtgcaaaatacacaactcataaaatcatagtgttctttccctcatcagctgacagaatcgttgagcaagctctgggcaacttctccttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggcaggccttcaagaaagcttgggagagcagtaagaccaaatagcgttggccagacaacctactggcttaggggcttcagggcctcaggctcagaagccacactaccttatggtatactttttagctggataaccttgggcaagttaccttgcctctctgtgcctcagttacctaatctataatggaactatctcacagggtagttataagaattaaacaagttgatatagaaataggatttctggataaagcacaggatgccccagttatatttgaatttcaaatgtacaacagataatttttagtatgtgtgtctcaaatattccatggacataactgtattctctctctctctctcgactgaatcttgctatgtgcccaggctggtctcaaatttctgggctcaggtgatcctctcacctgagtagctgggactgcaggtgtgagccaccatgtacagcatataatcatattttcattttccaaatctggcagccctagatggcaagcctgtggaagtgcacctagcactgagcaaatgctcactaagcattagatgttatgttcccttattattcccttcgggattgaattaatgactttggcatttggttttgaaaagatggttgctcttagttctgggtctcctcaaccatctggagttaaattgggagagcccagccactgtggtcacggcgcaatggagcatctctcctggggcatctgaccacataagcccaagtgatcaaggacccaccaccaaggccaccttcacccggctccactccctctcaccctctgcctctcaaaccaatcaatgccctttgtgggttacagacatggaagcacagaaacaaacatggctagagggaattggcagttactcaggcccactgtgtggtgggccctgtcccagacccccctcgtgttttctcaccgaatcctcccagaaactcagtgggtaaacctgaggacaccacctacaaattgggggtgataatgcctcccaaactcatagaattgtgaagaggaaacgagaagatgaaagtgaaggccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctcccctggttcctggtgccctgctggcctctgacactcttattcttccaagctgcactctccttcacagaaggtacctcttcctccaggaagccctcaaaccagcacaaggctgaacacacagctggagaaaaggacagcatgggcagaggatgcccttggctcactgcccttctcactcctccatgggcccagcctccctgggggtccatttcccttccctggaatcagccaagcactgagggctgggtcatctcccagcaagctcaccctctaataagccagcaggccacattttgttctccttaaataaatcttatagaaacatttaaatgtttatttcactcatagattctcaggaatgcacaatagttttcctaaccgcctgggcacagggataaatataggccagtgtcatagatgggaatattagcttcctttccccagagtcacatggctaggcccaggctaggaaactgtaaggaacacccccagccccagctccagcccactccagctcaggcaggcatggggggtttagatcctgtagatgggcgctggcagacagcccaggagaggaggaccctgctggaaggcaatgtgggctagtgaagaagtcgggtaggcctagaccagaatcccacctgggtgaccttgggcaagttactagttactaaacttctctttcatggtctaaaacattacatagagctaataatcactattctctaggcttgttttaagtattaaatgagagaaagcaataataatgacggtgaaagtggtggtggtgggtgcgtgctgtgagactgtatccccagatccctgtcttgtagcctggagggcaaacagggactgccttggtagagaggagatccagcagcaaaagcagccagtgctcttacaacaggataaaaggactctctgggccgggcacggtggctcacgcctgtaatcccagcactttgggaggccgaggcatggcctcggtggatcacaaggtcaggagatcgagaccatcttggctaacacagtgaaaccccgtctctactaaaaatacaaaagcaaaattagccgggcatggtggcgggcacctgtagtcccagctactcgggaagctgaggcgggagaatggcgtgaacccaggaggcggagcttacagtgagcctgatcgtgccactgcactcctccagcctgggcgacagagtgagactccgtctcaaaaaaaaaaaaaaaaaaaaaaaggactctctggggacttgaaagaaaatgattatcccagcggcaagtcctaggggcacaggagagagcagaagtgcctctgctgagttctgctggacatggggctcctccctgccaagcatagagggccagttccctggctccccaaaggctccccggtgtcttccctataggccctcccttgcaccaagggcctgctctgcctctggtggatcctctttcctgccattgtccatttatttctagaagtcagatataaagaacaactgccttgttcatcactgtttttactctcatgccaacagactctgggagtgtggaaaagcacacaatatatgttagctttattccaaggagagtaactcagctagtcgttcatccgtcatatctactatcctcccttccttcctcccttcctaacactactccaccctccatttcttctgccttttaatgcagtcatttagtcatctagccagccaattatctacccaacctatcacaacacaatcaagcatccatccacctttccatccatccatccctccctccctccctaagctccgaccgcatgctggagcctatgcttatgggtggagatacacatgtgaaaggcacagtctgtggcccgcaagtagctcacacatagcctgatgtgtggagacagaaaaacaaagaacagcaatctgtttcattgctcacaataggaactaagggaaaacaatttttatatgcatttccgactgtctgtaaccgtcaacatttctaaaacactttctgccttgttttaggcacttccacgctaaattctcacagctcttaccctgtgaccagaaccactagaggccagcctggtggaactgtcctcttgagctcttttttataatgatggagcatcaagcacctgtttcccatgcatggggcctctggtgtcctagctagggccaggaaaggaaggaaaacctggcaggatgacatcagtgggaaacttgagtttgaatctctatttgaccacagcacagctaggtgatctttgacaattacataaactctcagagactccatttcttcatctaaaaaatagagataataatatctaccttggagggattagaccacataccaggtgcccagtagttgctaccattatcttgtataccagatactaatattttattgataatttattttaaattattttattgaaggccttaattgaggctgttcttgcaaaggatgtgatgagataagtagaaatgaactcagagaagatgaattcaaaatcctcgatgggagcatccaagtacttcctggtttctggtgagtatagtgcccttacctgcctgttttctcatctataaagtgggatagccatcatgcctgtgtcttggagttgtcgtgaggttgctatgtgtaaagtgcctagagcagtgcctggcacatgggaggtaccgtatgagggttctcactggggaagctggggggcagggggatccctactctacacagtccttaccaggttccaagtgttttacatgctttatctggttcctcttcatctcattcctgacagataattgatcctttgggtcacacaccttttctctagtcgggcagcacacggttcccaaggagtttccagggaggtacaggcagaacctctctgttggccagtgaggacagggcttgaacagccaaaaggagtcaaatggatagagaagctggcaatctgccttcagcagtaaagtatatggctaaactcgagatattcccatagacagcgcagaacaagtctcctccaggtcctgatgggagaaggccgtgggagaacacaagagcaaattggatctgacagaactggcatttggtagtaaatctaccaggaagtgagcttcctgagagcaggaccttagttagttaatgctcaataaacatttattgagcaaattcaataaacattgactgagtaaatgtacttcaattcctcgattccatatttattgagtgcctaccatgtgtatgtgaataatcatcccttgcctctgtgctcaaactctattgcatataatggggtatttttggaatagaaataggaaaacaattaattatagcccatttcctcagcttacaaccatgagacagtggaatccgggccttgctatttccctattatgtgattttcagcaactggcttaacctttccaagcctcagtatcctgatctgtgaaatgtgcatagtcatcactaccatgtacgactgcgttctgaaggttaaatgctagaaaacactaggaacctgtgtgttagtttctttcccttcatctggataagatacctaactgctctaaattcgcactttcatgggggtgactctctctgctctgtctacctcacagtggttttgcacttgcaatgtcattgcacttgcagtgacacatgtggaaactttttgcaaaccgttttgtgctatagggactgagcgcctattgtgagctaagtactttgctcatcactttatatatattattccagtaattaaagtcaagctgcctgggtttgaatttagcctcaaccacttccttagctatgtcacccactgcacattacttttctgtgcttaaattctttatctgttactggaaatactaatagttttcccaggagtattgcgagaattaaatgagataatgtaacatataaaacaagcctaatatggtacctggcacatagtaagttctccataaaggttagctgttgttagtggctattcctataactcttagtttctagatgaggaaactggggcaaggaataatgaggaatcacttatccaaggtagcagtcaaggatgtgaagcccaagttcttcctgctctgccatgctgcttataccttacatttctatgagcctttcctgtaccttctggaactccctggctgcttggtcatcctcctcttcttaaaggacagacaggttggctctgagcccagcccactgactgagggtgtaagccaggataggcctcctacaacccttgtccactgtttttactctcatgccaacagactttgggagtgtggaaaaacacagtatgtgttagctttattccaaggagagtaactcagctagtcattcatccatcatatctactatcctcccttccttcctcccttcctaacattagccctccctccatttcttctgccctttagtgcagtcatttaatcatctagccagccaattatctacccaaccccagatttgttatggtggcacttacatcagtccctatttctgagccaaaacaggaggaaggccagcacctccatagccagaggttctaggtgctccacaagcagatcccttcctataagggccacacaaacaagactgcttctccagagcacactccaaccacatctcagttacttaaaagttacgggaggggaggggtgcagatgccactcatcagtggagtgctgcagtgaccttaagtcacaagagctactgcgtaacagggctgagcatccatgtctgcctagagcatcaacgaatgaaacacaaagtggatgctcggagagacccagagtgcctcatgcatgtggcctaaaccaggcaatagcatggtggcctgtgtttctaggagttaatgtgcccttccccttcctcaatgtgtccatgtcccttcctcattctccttcagctaagcaatcagacagcccactcaagttaaagttgggctgtttgattacctgactgaaggagaatgaggaaggggcatagacaggcatgtgacatgcagctttggttgctggccccacgagcttgtgctcctgaggggctggcaggcagaaggggtttggtggtgctttggcattcccctgacagcgagctctgaagttggcccttctgaggtgagtggctttgggaacacaggacaacgtactgttggcccaggtcccagagctctcactgaggacccaggggcagtaacagtgctcagtgcgggtatggactaagcatgggctttggggtcaggctgcctgggcccagatcctgggcctgccacttatgagctgtatgaccttggaggaaggtagttaatttctttgtgcctcagtttcctcagctatgaaatgggaatgataatacctaccgtaaggctaattatatgttaaatgagttaatatggtagacgagtatctggcacagggttagctattattattaagtggctttgtgtgcagcggaggtaggggaacaggggaggtggtagctgggtgctggaatgggtgatatgaagaggtgaagtctgcttatgagttcacactgacctgcccctgggggcttctaaaaccctttggaggaggatgggagttgttcaggtggaagctagagccggtgaaaattgggctcttacagctaacatgagcctctttgtaccctcaggtttacaaggcacttcagaggatgctgcactgtctgggtgagtcagcttcctactgtggctgctggtcacagtccaggaactcatctaggcctaggtaagattgcatctggagcctggggccaggtctggggccctacagtaaggcggagatgggctggtatgtgtcctgagcggaggttaggaaggctctgaacactgtcatgggagcaaagactgaagaaactagagaaaaagagactctgagaagactcagaactgcctttctgcatctgtaggatttcaccccactataggttgtatggagggcagaaccgagggagagtcttgggggaggcagattccagcctgaccaggacagagctggccaaccagtgcacaggcttccttgggaggcggtgagcttttcattatagaaatattcctacagattcctaccctgggcccggtggctcacgcctgtaatcccagcactttgggaggccgaggtgggcagatcacttgaggccaggagtttgagaccagcctggccaacacggcgaaaccccatatctactaaaaatacaaaaattagccaggcgtggtggtgcaggcctgtagtcccggctattcgggaggctgaggcacaagaatcatttgaacctgggagacagaggttgcagtgagctgagatcacaccaatgcactccagcctgggtgacaaagcaagactctgtctcaaaaatacaaagatatattcctacagattcctaagacctacctcaagagattccaattcagtaggtcttggatggctgaggaatctggtgttcaaaaaattcccagggtgactgagtggggctcacgttatagagagctttgcctgcctgggcggagcttagatgtgacctgggattcttctagcactggcagtctgtcattctgtggtcccctcaggtcccaggcttgtgttctgacagcttctattcctgctagaaccccttggctacaaactcttccctttgagtctctccctgttcaagggccaatgcagaaaaccccactcaggacatagccttacaaagtgcattgttggggggctttttgtggtatttgattgcagcttctgattaaggacctgaagagtacgtctgtctgtgcatgcctgtgtatctgcgtgtgtgtctgtgtgtgtgtatgcgtgtgtacgtgcagaaagagaaacaggatctagtcctacagattttgtgtttgtgtgtgagaaggcctcggctagtgctcatgccagtgatgggaaataggggctgggacctgaggaatcacaactagggctggaccccggggagctgtaaacttagaaggatgctctgttctttgcctgcttcacagactgggaattcaggcaggattgggacttccagccgagtcatcctggccaaccccgcttccttggctgcctggcctcggatgctcccagggactcaggttccagccccctgaaggctccaggccagctcctgaggcctgaccctcccgaggccgtgactacctgagaaacccaatgtgggtggtctggtgggtgcaatagtgggagaagcactttactcaccatgcctggttgccttctgaaaagctttgaaatgtccagggcgtggcagtaagggaagagggtaaaagaaagttgagtttgatgtggcctttggttgggggggtctgaactgccccagcttcatggtccctcaggctatagaaggcacttgagggctgggctgaacaggcagagtctaggaggcagcaactaacccttgtactgggtaacacataagaaaccagcagcacagcaaagttaacagacttggtctcaaagtttcttggccaagacaaggtctcttgaccagaatgtagaggagctgggattgaagcccagcttggtatgactgcacagtttacattcttaaatcctgtgctaggtatcctccctgataggacctgggcttctcggctcccggctcccctgaattcctgctggccttcctaaccatcacagcttcaaaatgcatataggtacagtgccattaggttggcatgatgaatttctagaggttgccacaatggggggagggttccatgagcttgcctgccacaaagttgagagtaagcgatccctgattggctagtgggagctccaaattccagttccccacaagttcagtctccctgtgaccctgagccagaaccagactcttattaaataacggatggtctctgaaggcccttcaagtgccatgattctctctgtgcccatgggaaatcaagactatagagagaatgtttgcaggtactgatagcttctgcattattggggcccagcagaaggacccatgagggaagaatgcatgagtgaacattatttttacaaatgggtagattcttagtgaatattctcatgttatgattacatttgttttcttacacattacaactctgggaacttaagtaacaaacactttaaaaagaatggccctttggatctccatatcccaaacccatgggatcaagatgttgtagaacttggcagtcttgtgggtggggagatgcccttcccttgaatgtctaagtgacaggtgtctatgttgtcttgttttatgtttcctgaggatatactctgaaagaacttttaattataaagcattgtaagcaggaagaatttaatataaaagcctgtcttcactgacagcaggggtgcatctttgctgatcttttattatcttatattttaggaatgcttttagtcttggggcagctgtttgggggagttgcccaggatttaagagctacattttgcctgagaatctgattcaagggtactaccattgttagtaaagtagaaggggccagggatggccattttcagaggagtccagggcgaggaaatagggatgctaaggagacagaggccaagaaagtcatggcctgagggtctggaagcagtcgcatttgaatgcagttgtgagtgttttgtctctcctttccttaatccccaagcttttggaacttggcaccctcagcagcaggacccactatttcccagaatgggggcctggacttgataaaaccctgggctgggctgcctgaggctgaagggctagggggttggcccactgtcacttagacattcaagggaaggacaaccccctcacccctaaggctgccaagttctgcaacatcttaatccgatgagcttgggatatgcagatacaaagggccattcttttctaagtgtttactatctaagttcccagagtcgtaatgtgtcagaaaacaaatgccatcataacatgaaaatactcactaagaatctgcccttttgtaaaaataatgctccacttatagattcttccctcacttaaaaagcgtctatcccacctggctcaggtcagtttggatgactgtccgatataacaggacaataccatttcaatgcaaatcaactgcaaagttcatgaagtcaaagaaaacagtgatggagaattttacatgcaaggtctttgaccaaggagatcagatagagcttatcaattaagtgaagaaaatacgacgaggatgatgctcaaataggttcttcaaaagggaataatttgaatatcgagggactgaaagagatccttggggaaatggatgaagcccttaagtattaaacagacgtagactcttaattaggtgctgtaaagtaaaatgtgaagagcgagttactatgtgaacagatcactttgctggtataataaataaatatacccacaccaaaatcaacattttattctttcttcaatctgaaaattagcacataacctatattttgtaatctgtatagctaaaaatagcttgttttgaatgcctcatttgtacaataaaaatcttgatgtctctttaaattaatctgctttcatcatttcctttctataataaaatttcactgaaaaccttttttgctatttactatacaattttgatctccattttaagtggattcactttaagtggccttttctcgtgcccactcacctgacataagaggttctcagtgctaatggttctcatataagtccttctccggtttcagagggagcctgcatggtttgtggtttgacttctgaggcctcagtcagacacagcctagatggttggttctatacccagaatatttggggcctcggtcaattcaaaccaactcagagtaattgattcctcagtatggaagccacacaccttctccaggtacccactgcaacctacatgagctgtcagcaaaccctctggccagcctaaaagctgtggcctcagcccagggtgcttggcttggcccccagccaggctagctgagggcagggagggggcacttacttggccggcagggctctgggctgcctgtggctctccggggggctcctcgtcctcgggaatgtggggcatggcagcctcctgctgggagtggccacgtgtgcccggaacctccgctgcgtcagccccaaagatgctccaagaggcctgggctccacaggctggggagatgccaaaaggacaagtcaaatccattcccatccctgtcccaagctgggttccatttcccggagccacaagccacagtgagagccggcttgagtttgcatcaacaccggaggtcaaaccaggctaggagagggcatttggaatttcatttcctccggctctctggctttgtttacaaagtcagaggtgaccttagagattttgcatctaatttggtctttacagtaaacacagctatcccagaagggagaaatgtgcttcgaactcctcaaagctgtagctaatggaagatactccattgagatcacattggcagttgtttaccacttactgagcacctactgggtgccaggccctgtcctaggagcatcaccatcatctgattgaatcctcaagatgacctctgatgtaggcattaatattcccattttacagatgagagaaccgccccagagagtgaaagtcacttgccccaaatcatacagagaaccaataatttgaacccagatcttcctgattttgaggctggggctttttctgctatactacacagtgttcctcagccatgtggatggggagtaagaggtgctgtttcctgacttcctccctgacacctcccctcatgctcttctgaccctcagcacaggctctctcatttgagttcagcccttatggggactacaccagccctactaaaacctgggggctcaggcagggtgaattccatgtgccctgtgcccacccctggcaaccttagattgactcccagaagccaggctatcccttccccatggtgcagcagcctgggggcactggggtcccagtgctgattgggactgcaatcagcataatctcatccacctcccacagtgactggctcagggatagacaatggacccagcctacatcgatgagcttaaagtggtgttctaggaccagatgctttctcctgctctgagtggtggagtgtgaagatatgagacctggtgctacggacactattttgcttccatgaggaaagccagacagaatctaaatgatacacacagaggagggcagagcgaagggacctgcagagaaacagaactggagccctgattaaagtgtgcctgaagcctgaacactttctggactagctggttacatgaacaattaagcctcttggtgttgaaatcactttgtgttgggtttttgttccttgtaactgaaaacatgctccactactctttcgtgcttcttgtctgtcaagatgcctaggagtatgatcctgccaacagacctgagccaatgggtctagctcctctgcttcctcttagaagaggagactagcaatgccaggtttccatagggaaaggcaggatagcaatgtagaaagaacacaggctttggaaccagatatctcggtgtgagtcctcactttgccactcactggctatgtggccttggaaagtaggcttcatctctgagtcccagttttcttgtcaaaacagataagaatgcctcccaagcaggatgctccaaggatgaaacacactcagttcacagtagttcccacagaggccacctgcacgggggtctgcagcccaggaagcttggccgaagctccaagggctctgcctggcctctccccatccttaaactccctccttcttttattagtggggtgggcaataccttcaggaatctatagaactaacaactggcctggttctgcaacttttagagattccctgaaggagctgctccactgcacagtagattaagaccaccatgcagataacatagtgaggtgacctttggctgatgggacatggtgggtgggggtggagatgaaggacactgtcatttactgagcaccaactgtgttccaggtcctctggaaggtactgctgactgctggaggctgtaggaggaagaaccggaaagccctgccacctcccataatacttggtgttcttcctgtccttcagaaagggctcggaaagcccctagagtcagggcactggagaaaaggcctgagctgccatcagcccagctctgacagaccccccagccaacacacatacctctagactcctggactgagctccttgagctaggcaaggtgtcagattcatcctaggtacccaaaagattcagcaaagaatgattgttgatttatgtttaaagaactagggacttttagccccaggattggtcaaggtgaccaccatcttgattgctgtctttctctgcaatgaacaagttagcccacacagctctggaacagttagggtgacccctactggtcacctcaagaaatctcaagtagaccatccatagagtcattcattctttcactgccaaaattttacacctactctaccaggcctgtgcaaggggctggtgacataaagataatcttggccttcaaggaacatagagcccagtggtaggagacgctggagaacagtataatggggtaaatattttgaaagtgagaagttgcaggaccccagaaaagggttacctgtgggaactgggatggtgggacatgattttagcaaatatttcacattacaaatgtttgagctgagccgtgaacacaaatgctgagtggaatttcttggaacagattagctgggtgtctagtggggaagataagacaggatggggagaagccacattggacagacttcacctggctcttgggaatgagaactacggggccagggcatgctgtctgtgtcttccatgccaaattcttactgtatgaataaactgagcatcaggttcacccaaaggtgagctctgtgattaatttctatcatctttacttggatttcagcagcagtggcatcagtggtgctgggtaaagtatttggtaacaggggttgagggtagcaaaagactagccacaaaccctgattctactaaaggaagttggctacatctcataggaaaccttttaaaattatgtgtgacgtatgtacaggtccaggctgtcttaacaggggcatggtttctaaaacatgggaggtgactattccacttttcttttgtcttaatctacacaaagtatattgtgctctgcctgttaagaaggatttagacaaattgggacatgttttgaacctgggaagcaggaagcaaggagaacaaaaatttgtgtttaaagaactagagaactttagcccggagaagaggaagtgcagggagaaataaaaatctcttctcagatgtttggaaagcattcatgtggttttactgttcccaaagaatagatgtcataactaatgactgaaaggtcagatgaaggcaagggacgaccttctagtggttggaaccacctgaagatgaaacaggctgttctttaaggtagtgagtccccattccttggagcgttctcgtaaagcctgggacaagggtcacaggattcctaaccacttcaggggccttttctaaccctgggagtccctgaaatcctggactctttttagctacaacaaactgaaagacctgacgattccatcccaggactctgggattatggtctgaagtctcatgagaaatacctcattttttaaccctctactttcttcctccacctccctctcttccaaaaagagcttaagtcagtccctgtgacagaaagcagaatagaacaaatgagttaagtcagatgtcagctgccacaacataaaagtagagtggatgcttgctgaggccccactcttgacaagatggaaccccaggctcctcaggggagccccagcagccctgcctgcaggggccattcccacgctgctcctgccctgtttgctgtctctcccatccattattataaactcgctgcttaaaatagcaaggtaaaaggagagtccctgccccagggtgacatctgggttctgctggagcttgtgggcacacggacctcacatccatcactgcaaagtttagaatataatctccaggaagtgctgatctagagcaccaacccataaaaggaaaaaatatttagtaatgtttggtctccaagctgttccttctttaacccattttcagggcccttcttgctgcctctccagtctggttcggaaagggttaggtaggccagtgccaagagctaatcagcttttatgactctactcattctgcctccagctagtgcctaactagaacctggcccattttacaggccgggaaactgaggtgcagaaacggaaacaacttgactggttcagctacccttgtatctggtgcaaatcttccaagagactctgctgggataactatccagtaatttgtgcaactgaagaggctagaagttcctaaaccatatttaaatattttatctgcccctgctcatgaaagaaaacaaactaatatgcttttgttcatgctttcattcttcagctacttctaagtcgcctactgagcatcggacactatgctaaatgtatttcaagtgctattttctttaacccccatgagataggttttattatttccatttaatatattaaggatctagggctcagagaggttccgcaacctgctcaagatcacacagctagtaagtagctggtgaagggctataatccaggctagtctgactcctaggcccgccatctttcctctcttccactctggcttcttcaccaggagttctgcttgagtgtggcagaaaagactagcacgggggccctgcctcccaggggagggctggagtgagtactcccagtgaggctaaggatggtgggaggcagaggggaggaaacaggacctacacttcggttgtcgggccggggtcttatgagggctaaagagtggcctacagttgagcctgcatgtcctctggtaggtggtagcagcaggtggaggacgcggaggccggccctgccttgtaggcttcaaaggccttactgtatcccagaaagtatagagccatcatcgggacgcacggttcaggaacagaatttacagagactatctctttcagtgctgtcagcagccctgtgagatggggagagtaagtactattattattaacattaaagttagacccatgttacagatgaggaaacagaggcccagagacttgcccaatgtcatcgctcatgaatggcagtgctgggaattcaccgaatctgggtctgatgctccccttccttgcagggccaagcctgttctcggcaggcagcagcagcctctcatcatggcgccaaagatgcctctcccagagccttgcaacctgcctaggagagaccaaactcctctctgaaaccacagtatcccaggagcacagcccgtaagctaagcggctctcagattctctctgtgaatctttgagcattgagggaagagccaagaagccctttcgggaaaccatgggttaacctagcctccactgacctttctggagtgactcagtattctcagaagggagtttttttgttcttccagctttgaatttttgctttcattttagcagcacaaagaatgtgaaagagattaggttgctattaataccacgggtctatctctagatggacaactgatggggggaattgttgggggtgactgcacgtggagctctcttagcccttctgcaaatccagagggtgatggagggacactgagaactcaccagtcttacccctgcacccatttttaccaatggggaaccgaggcccagaggggcaggcatgtgaccaaggccacatctatgagtgaggggcagagtcagaaaagtccccagagcacccatgccccgagcccggctgcatgtggcagctttctgacttttcattttgacggttttgctcatagtaaagggtaagccattgtgtctgtgctgtgaaagcaggcgtccttcggcagtgactcgtcattgttcttgctctcatgctctcatggtcactctcgcaggagagaggatgctccccacaggagatctgctgaaagtgctgggaggtgcctctgggggtcccctgggcctggccaactgcagagctgggttccgcgactccacaagtgagccggatgggaagcctgccttgggaaagccccatcctgcttcctaaccttggcctgctcacggggctttgttgcttggcagattccgttctaatccttcctctgcctctcccttgctggataaatctcccctggcctcagttccctcatttgaaaatggaggtaatagcacccaccttttagcgttgttgtaacgattaaatcaggaaatacatgcaaggtgctggtacatagagtccactcagtgccctcgccattctccaaacagggcagctgagttctctaagcatgcacagcatcaacaaaaccaagccaaggctcagagagactctggtgttcatcctagtggctcagagctcccagatttgtctcctgcaagtaaaagagactcagtcctggtctttgctgtggacagtcccaggtctgtgctgggcttgccccatgtctgtgctgtgctcagtcccaggtccgtgctgtggtcagtcccaggtctgtgctgtggtcagtcccaggtcagtgctgtggtcagtcccaggtccgtgctgtggtcagtcccaggtccgtgctgtgcttgccccgtgtctgtgctgtgctcagtcctaggtctgtgctgtggttaccccatgtctgtgctgtgctcaccccatgtctgtgccgtgctcagtcctaggtctgtgctgtggttaccccatgtctgtgctgtgctcaccccatgtctgtgctgtgctcagtcccaggtctgtgctatggctgcccaaggtctgtgctgtggctgcccaacgtctgtgctgtgctcagtcccaggtctgtgctgtgcttgccccagatctgtgctgtgcttagtcccaggtctgggctgtgctcagtcccaggttggtctggtttcaaagccccagttctttccactatccctgtactcatgatgactcccccaaaacagaggtttttgttccacaggtgagacatgaggcctagtgtggaatccctcctggaagagagccagccacagtgtctggccaagtaggtatttgtgctgtgctgaacaagtgggtaagtgagtgactgaagggggtacagccaccccccagtgtgtggtggaagccccaggattctctcctgaaagtggatctagattgaagggaattgtgcaggagcaggaatggtgaagggcggagatgcagggagaaagcctcggtggcaacagaaaagggaggatgaggaagtggaagtcacttcccccaagactgtgtcccctaaacaaagtcacgtttcgggaggctggccctgagaaccccgacaatcctggggtttgcacctctgtgggaaaccttcttagggcccgattttctccagccctgctctccgctcctgtggagctcgtataggctttgttggctgggggtgccctgggaaggagccagcacctgctcagaccaatgacaggaaataagcctaaacatctccccaggtttcctttccagcttgttcacttcaggaattctttttttaaaaataggtccacttgaaaaaattttttcttcttcaaaatatgtacaattgctcaatcggaggcagttcaaaggcaccgagaatagcagcaaagtatctgagcctcccatttagcgcctagcagatataaatcttgcccagttctgtttgttccaggctgctcagcagcctcttccctgagtcactcactcaagagtgacatgagtcatcatcctggggtcaaggaccacacggcattctgggtctgtgagatcccataaagggcagggcaccgaggggtctccaggaagacatggaggatcaggaactgtctcctaggccctaggcttggctctgcctccccacatgggtgactttagagagtcactaagcctgagaagtaggtggatttctgggcccttctaacttgtactttggaggaatctctttagtggtgcacaggagcctgcttgttccagctcataagagtctaatgtaattttcaagaattctgtgaactggtggttaaacacagacattattaaaaaataaattacatgaactcacattaaacaaaaaggagataaatactcaaaataactgctttttaattattttactacattttactattatctatgctcttctgaagatttatttctattgtctctgcatagcggaaactatataatgatttgctactgcccatctcttctcagttccatgatcagtgagggtgagttagtagcttgccattggtcatagtgggagtatctataccatggaaattggcaaacactatgtacatatcagggccttttccccccagagagctggccgtggaacattgccagcacaccactgagctactcagccccaggctccctgattcttgctcctaccagggtgcagaaggaacacagatgactttagtatcaccccaagatagcacagttatggagacttcattgccaattgtctttggacaacttttcccaagtggactatgaatcccttatcctcaacacatccctgacagagctcattgtttctttccctccccagcccactcctcctgtgccccagagaatggcactcaagctacaaacctagaagtcaccgtgactccttcatttctgtcaccctccacattcaattagatgactctgagtcccatcaatcctagttcagaaatgcccttcctcccatccctggcacccctgcccatggctctgtgtgacctgagtcactgcaacagcctcatttgtctccttacctctggcctggtcccttccaatgaccctccataatgataccagagcagtctgtctgaaacacaaattggatcatccttccccttcataaactccttgaggattgattcccttttaccatgggggggccagttctgagtcaagctcctagcccctctctcgaggctgatcccctctttcaacctttgtacaccttatgccccaaccacagtggaccaaaagccaacctccaaacatgccctgcttttttacaccctttgcatacatcctcctccttatacttgggctgccttctgtcctccttctatactttatgggttcctacttgtcctccaagacccagttcacatatctcctccttcataaacccattcctcctcttcacctcaggaaaagttactcccttcctgtagtagtttcctactgcgtctgtaccaaatttccacatatttggtggcttaaaactgcacaaattcattatcttacaattcttgaggtcagaagttcaaaatccatctcagcaggctaaagtctaagcatcagcagggctgtgcttcttcaggaggctctaggggagaatccatttcctgccatttccagctttagaggctgcctacattcgttggctggtgacccttttttctccatcctcaaagccagcagagtcgctggcatcttttctcccctctgatctctgcttcccccttcacatttccttctcctctgactttcaccgtcctgcctccttataagaactcatgattacattgaacccgctcagttaatccagggtaatctccatctaagtattcccaatttaatcatatctgcaaaggcccttttgccatttaaggtaacatcttcataggttcctgggttaggatgtagacatcttggggaggggggagtattcagcctactgccctatcctcccagggtactttgcccagaactcaacccaactagaatttgaacatctcaagagcagagactctgccttattcatagctttatgaatattcttataatattcatatttttatgacctgcctccagtacagggtcaaacacagaataggcattcactaaatgtttattgagttaataaatgaatgacaccgtatttctaaaaagcagagaagaaggttttacataggctgggtgcagttgcccatgcctgtaatcccagggctttgggagatcaaggcgggtggatcacttgaagtcaggagttcaagaccagcctggccaacatggtgaaaccccatctctactaaaaatacaaaacttagccatcatctgggttgctatataagcaagtgggtggccttgcctgccctcattctcattgagcttccccaggttaatggccaagtttttctctctctcgatgatgtacccgggtttcatgtcttctctgccacacagatgtgcaaatttctcccatagtattctacaactaaaacctcacaaaaggccagggcctccttctctgacaccttcatgcttctgttctgccatccaggagtaatttgcaaagtgaattttcagattaacttatcaatggctcttctagctttaacctaagcctaacagaagaccacagagcagccccaccagcccctctggctccgcttggaatgctgaccaaagcatttcctcaaacagttggttatgtgtgttcaaatgcggcagcaccctcgtgtctgctgctgtggtactctggaaccacctccttcctgacagagcagagccgggaggctttgcaaggtggtcattgcctttaaacccagacctggactcatggcttgattcctgctccagcaaaggcacagactctggtattaggggtcctggcaatccagcacctgggattgcccattcccatgaagcaggcctctgggaaatgtaccttatttcaggtagaaggcaggaggcactgtacccacttgatgggatcgcactaggccttgatggccttggttctttcagaagccaacatgtgggctgaatctgagccaacggcctcttccttggatctcccggcctctgaacctgaagatgcccttttcttaggatgggagcaaggatggataaaggcaagctggtgttttgtccaggcccagagatctgtcaagggccatctagaccaccaggaaccagaagaggcaccctattgccttggattctttagaaactttgttccaaataaaaataaagcttccttgacttggcaacaccacagcccaataaataaataaataagcaaaaaaagaaaagaaaattaacacccagttcccagtgtgcctctctcattcagttcctcctacttctccatcatctccccttcccttcctagttttcttctaggaagaggtcatcagggtctattaggaacctgtaggaatacatataggaatataggaatatatgtaggaactggtttgggaaagtcagaaggaaaagatggcctccatggtgcctgcctaaatcattcacccattctagaaaagcttgttgagtgcttcctatgtgttaggtactgtgctgggcactggggctctggggtgtgtcctccaaggccacctcctccaggaaggcttccctgacctctcctggaagctatattctcctctggtctatgacagcactgtgtggctatcccaatctgccaagcagtggtttctgtttctcatttgcaaagcctgagggcagatagctttcttttgtaacacaggtacagagaaagttctcaatacctggtggatctcttcttttgaaagcaaggactctaggaatcaagcctcacttttcacatggcctactacacacccagcacaatgtagatacgctagctcttgaaccatctcaggtctgtgagaaaggaattacttgtccattttacagatgaggaaatggagccttagacaagcaaagtgactcgctctaggtcacacagtcagaaggcagagtcaggattaaacactgggtctcctctgcccaaaatgggatgtttggctcttccttagagagagcttattcctatgcttctctaatcttagcaaagacagaacaagggtattaggagatgttttttgatagggcagtgctcttgatcattctagatcccagctcttcctcagggccagcacagccaacaagaacaacagcagccgagacgcagcccctctccgaggaactggaagtccttctcacggcatcccctggggtagacaggaagcagctgcgactgtgatcatctaagaccagcaggagagagtgttcttccctgctgggatggagcaccccagctcaggtccccgcctcctgttcatctccactctgggaatcccagttctccaaagccatggaaataggcccaataaccttgggctgggctgctgggcaaagtctggtgtaaagcatgctacagaaagctacagcaggattgagataggggttcagggacagggccttgtggggagtgaagagcagactgccatgctaactgcctgtgtaggaatgagttccttcaccattcaggcctcagtctctccatctcaatagtaaaggctgggctaacttgccagcctgagccctgctttctgccccatgagttcaagttcacgttgcctattgaaagcagtcacacagtaggaagttaggggccttcctggcatcccagggctggaagcagccatcacatccccctgatcacagtgattggctggagggtgagcatgtgagctgacaagaaccaatgagatgcaagaagacattactgggcatcctgggaaagccatccttaactgcagccttgagttccagagggtgaaagcagaatccctcttaagatgatgaagaagaacttgtctaaggatggaatcaatgtgagacagagcacagctaagagccagaaagaaactaggtcctgaggctatcttctcagatcctgatcaagccatgcctgatatccccagccttttctgttttgagaaccaatgaataccccttttttcttaagctggcttgtacgagcttttttggcacttgcaataaagagttccaactggtgcaaacagcctatcctttataatgctgcctgtggggactttcttggcaccaagtcttctctcacctctctactgtgctgcttacctaaccctaaccctaaccctaaccctgagagtttaagctgggaactcagatctagagttgatgagcttaccctaagttattccctaacttagaatatcaccatgcccttttcctcagaacctgttcctctttctgcattccctgctaccattggtgggcccagcatctggccagaaaccccagcccaaacacagaaccttctcccacctctccaggatgcctgtccccacttctttttactaatacacacatctaaactgttagggctccagaggagtgactcggtttgaccaacctccatgttcctgcctagacgatagactggtacacaccaagatatgtttgttgagtcaaatttcaaccttcaaatgattttcaaacatcattacttcctgggggcgaccactccacctacctatccctcagctcagagctggataggctctcactctcaaccctccccagaagagcagaccccaagaccgggacaatgattggctgtgtgaacaggctcgcagccctgtgcttggaaccccagcaccagagtttagggtggagactcccatgtgcaggacaggaaggaagctcacaccttgccgactgaggccagcagcagggtgggagcagctgtggatcttggccagggtctttttttcaccaatagactctgagctgaactgcaggatggtgggtgtgtacacaagaagacacgtgataaagtaaaagtgagcagtcccttggttatccagatgtatgcaaacagctgcattagctgagtctttagacccaagttgagaacaggttatggtgaacagtgatatgcaatggcaggggtgggtggaagccgggagggtagagcctgggaatggctctcccaacagcaagctttggtgattagaggcccatgtatttcaaggtcctactgcttaaatgggcatgtgcaactgtgactgcctaatgatatgagattggaagtaaccatagagaatttctccgcaggggagtcatttttccaccatggagaggtggggatggtctgggagtaattctgaggcattagcaggagagaaactgacatttattgtaccaggtgctctacctgactctttacatcctttatcttatccagtccttacaacagccctgcatggtacgattattcccatcttacaggtgagaaaattgaagctcagaaaggtgaagtaatttgtttcagacatcacaattactaagtaatgttaacagggtttgagctcaggggagcctgactccaagcccagggttctgctcagtataccataatgaaggcttctaggtcaatacagagccaggcgacagcagcagcaacaacttcaaccaaaaatgaaatgctaacacaggaccagaagaggtttttctggctaaggcttcaccagtttgtcatcgtggagaaggtatcatccctaacaatcagatttacctatgttctttgttaacctgcagtttgttatacatgcaatagctctgcttaagttaactggtaaatagcatagagtttatccaacgggttaagctgagtcattctcgtgaagtattttcttgtttttagaaaagactgagtaaagagagctctgagggcaggttaaggccagggactgcctggagatgcctcagcagttttgctggagctgttctgggctgtgagtgggcaggcaggtgagcagacccccttcctggcccaggttccacaaggagcataggcactgggaaatcactgggttttggcagggttttcttggatcacactagcaacattaccaaggcctgagtggagctcctgcaccctggggaacattttcccagggtagcccccaggctccttaggtcggctcagacacccctctttcctgtgcccacagttggtatttcctagttataaaatgattttttcattaatgctatgatagaatgtagaggaatgtagatatttttaatatgacaacatatgtttatagaacagaagttttttttttcgtttttttgtttttgtttttaaagcacctaatttggagtcaccctggatcccagaagccccaaagtcctgggacattgttctcgtggcctttcatctcttttcctctgatcttctggatcccctacacagggcccttcctctagggttggcagagtttgggaaaagcaaaggccttctagggccctgggctggaatgctggctggggtatggctggcaggctttgtggttgggactggttgggagcagcagctctgctctgctcagcctgcaggtcagcactggaaggcccaagttgggcaggggccccaggacaggagggagggagccgctactcaatgctttcctgatatcctcttactgcctcagttacctcccaattccctactcataaaaatctagccatcctgcagccctattcattctacatgtccagatgagaaaagctgataaccagaaaatcgactcctggggtaggtggagggtggttctcctatgaagtaatccatcttccacacagctggaattctaaaacataggtgtggtcgcaggcctccctcaagtcaaacatttcaatggctttctgtgtgctgactcccaagtctggctgcttactaaaagcacctgaggtgcttgataaaatgaagattcctacacccttctcagatagactgactcagaatatctgggaatagggcctgggaatctgtatggctaaaagcccctaaaggggaatctgatccaaagaccagagctggagaagccctcgtccacagatgaagtccagtttcctgggcactcatgcaaaactttctgctctgagactgccaaacctctctgttttttctccagccactaacaccaaggtatcctgcaccccagcctcacctaatgctcactttccagaatattccacgtgctatcaaacctcagtgtcactccctctgcctagaaggccatccccccatctgtctccatgaaagaccctactcatccttcaggagccaccacatgattctcaccagattaaaccctctgccccatttccttttagcattttaaattgtttagttggaaacatagactttaaccttctatttgccactttctagctctatgactttggctgttgactttcaatgtcctcacaaattattatgaaaaatattcaaatttgaaaagtatgtaaatgtatgtaaattagatatacagtgtctagcacaaaataactaacagaatggtaacttttattattattattcctatattatgatggcattcctctaacacagagttcaacaaactatggcctttgggccaaatctgaccaactaatggtttttgtaaataaatttttatcaaaatacagcacaaccattcatttgtatattgtctatggctgttttcatgctatgagggcaattgagtagttgaggcagacactctgacttataaagccgaaatatgtactagctgccttttttcagaaaagttagccaaccctgctctaacataattgcaattatttttttatagtttcgtctcccctatttggctgagagacactcaaggatcttcatggcagactcctgttcatccttttaaactaagtctttctcatctttgtatctctaacatttggtatataattagggcttggtatatgttaaattgaagtgaataattctttaacccagtttaaatgcacacatctcctgaaagccctgatgggaagatggggtaagtgccagcagacctggctctgaggctgcctccctcctggcttcagcatcccacagtctcactgcctcccaccacccaaaacccagcactctgtgctttgcagctgtaatatttcccctgatagagaggggaggaagaagtccttcaaaggttagtatattcccattatccaagagtgtacaaatggatggtctaatggtccccatggtccttacagggggcaatttggtggacccatttttaataaataaactaatggattggtattttttctctggagatctatattttgtttagtttcaactacccatgaatttgcattcctgacaaaagctccttttgagaagagaactaggatttccaagcagtgagaccatttctttgtgagctgtttatgaaactactctgtgaccttgggccagtcacccgcctctctgggcctagctttcagtttctgtataacaacttccagacttgactccctggagttctagccagagggatgaaccaactcatggtgagtgaaaacagtggcctggcaacaggcagcttgacagagtgtcttccctcttccatgctgcagtagcacattccctgtcctccccagcaaatacagcgactcatttctactgccttttcttgaggcttaaggaagatactttagccctaaagtagatcttcagaagataagaaaatgccatggtgtggaaaactctgtgctggatgaagtggaaacactcagctctcccccgaggccagatgaaaagcacatggatgaaagccaaagtccatcccttccttgagcctttgggagcagcagtccaccctctctttcagaaagtagttcccccccttacccttcaccctccttgcagacacccccatgggataaaatactgagcctgcaggatcctggttatctgggggcaaatcggtgtaactgtggattgaactgacttttattgatttcccagcaggtgatttataactgcctgcttcctaaaagggcttgtggccagatggcaataaaaacactcagaggccaagagagttaaaaataaatgctgaaaaagagagcagaggaaagagggagatagacagctgcactaaccgaggtgggatgactgctcagtctggatcacagggatgggaatcttgcttttcagttcctactgacataaccaattgagatcagcagcaccttgtttttggcttttgcaagaattgcagagcaaggagtagctacatcttgagcttccaaaactaacccttagtccaacagagaacaaaattgagtgagattttgcattttagaactttataaagctcacttcacagagggactcctcatacaactatgtcaccgtactgtttacacaacaggatctggaagtactttaaagccggcagtgtaaatcaaattctaggtgttatgtacatgtctgagtctaatggctggtcatccaccctccttgacttggctttagagtagtccttaactaaaacgagttctagggtcatgcaaaaccatgcacaaggatcctttagcttagtgaaaataggcagtgctttctaattctggccataggtcactgtcatttggtggtcacggtgaattggttatttaacaaattctgttttcactagttgcaactaaccagaaatcagatctctcaaaggaaaaccaagaaggctattgctatgggcttaattgtgccccccaatactcctcctagttcttatgtcaaaatcctaacccccagtacataataatgtgactgtatttggagacagggcctttaaagaggtgattaagtttaaatgaggccattagaatagaccctaatccaatctgactggtgtccttataagaagaggaaatttggatgtagaggcaccaaggatgtgcctatacagaagaaagaccatatgaggacacagagagaaggtggccatctataagcaaggagagaggccgcagaagaaaccagacctgctgataccttgatctgggacttccttagaactgttagaaaataaatttccattgtttaagccacctggcttgtgatattttaatacagtagctctgacaatctaatatagctattgatagaatctctcagccatatcagatttaaattcaagtctgtttcaaacatttaatctttgaaatagggatcaatacattttggagaataattgctttagtatttttccaggctaaccacaaaactcctttcagaacctttctaatgaaataaaaattctctagactaggtcccaagaattctacctttgaagaagtaaaattatctctatttgcaggtgatatgatcttatatatgcaaaatcctgaggaatccactaaaaaactattaggactaataaatgagctcagcaaggctgcaggatatatgattgatatagtacaatcaattatatttctatacattagcaatgaacaatcaaaaaatgaaattaataaagcaattctattcacaatagcatcaaaagcataaatacttaggaatacacccaacggctggccgggtgtggtagctcacacctgtaataccacaactttgggaggctgaggtgggtggatcacctgaggccaggagtttgagaccagcttggccatgatggcaaaacctcatctaaactaaaaatacaaaaattagcagggcatggtggcgcgcacctgtagtcccagctactcaggaggctgaggcatgagaatcgcttgaacccaggaggtggaggtttcagtgagccaagatcacaccactgcactccagcctgggtgacagggtgagactctgtcttaaaaacaacaacaacaaacacaacaacaacaacaacaacaaaaaccagaaatatacttaacaaaataaatgtaaaacttttactctgagagatatgaaatatatttgaaagaaattaaagccctaaattgttggaatgccatctcattccaatttcatatggaaacacaaggaagcaacaataatcaaaacaaactaaaaagaagaaaaaaattatctacacatcccaattgcaaaacttactataaaactatcgtaatatagtatgatactatacactatacaagaagagacatacacatcaatgcaacagacttgagagttcatacataagcccttacatttatagttaattgatttcaacaaggatgccaagacaattcgatggggaaagaagtcttttcaacaaatggttctggaacaacgggataaccacatgtaaaagaataaagttggacctcttcctataccatacacaaaaattaactcaaaacatctaaatgggagagctataactatagaattcttaggtgaaagcatgtgagtaaatcttggtgtccttggtttagacaatgccttcttagatacaacaccataaatgcaggcaacaaaagaaaaagtaaataaattggacttcatcgcgatacaaaaaattctgtattgaaagtgatgctatcaaggaagtaaaatgacaacccacagaatagaaaaaaatttgcaaatagcatatctaataaaggacttgaataaagaactcttataatgataaaaagacaagtaatacaatttttaaatgggcaaaatatttgaatacacatgtctccaaagaatatatgccaatgaccaataagcacatgaacagatgttcaacgtcatcaactatcagggaaatacaaattaaaacagcaataaggtaccactttacacccatgagggtggttaaaataaaaaagacaacagcaagtgtcgactaggatgtgaagaaactagaacccttatatattgctggtagaaatgtaaaatggcgtaaccgctttggaaaacagcttagcagttcctcaaaaggttgaacataggattactgcatgatctaccaattcttctagatatgtacccaagagaaatgaaaatgtatatccacataaaaacatgtacacaatgttcatagcagcactatttataatagccaaaacatggaaataaactaaatgtccataaggtaattaatggatgaataaaatgtggtatattcatacaatagaatctattcggtcataaaaaggaatgaagagccaggcgcggtggctcacacttgtaatcccagcactttgggaggctgagacgggcgaatcacttgaggtcaggagtttgagacaagcctggccaacatggtaaaatcccgtctctactaaaaatacaaaaattagctgggcttggtgccgtgcgcctgtaattccagctactcaggaggctgaggcatgagaattgctttaacccaggaggcgaaggttgcagtgagctgagatcatgccacttgcactccagcctgggtgacggagtgaaactttgtctcaaaaaaaaggaatgaagtaatgatataagttttaagtttcatgctaaagtatgaaacttaaaatgaatgaaaggatgaacttgaaaatattatggtaagtgaaagaagccagtcacaaaaaaccatacgtattattttatttatataaaatgcccataatagagaaagctatagagatggaaggtaaattaatggttgcttagggctgagaggatggggaaatgggacgtggctgttaataagtgtggggtttctttttggatgataaaaatattctggaattagttagccatgatggctgcacaactctctgaatatactaaaatccactgaattgtacactttaagtaggtgagtcatatggcgtgtggattatattttaacaaagctgtttaaaattttttctaacttccattaaaaaaaaaagagaaggaagctagctttggtccttagtgccttgtgacctctctgggcatagcttcctcaaacataaacattagaaattaagctcgatgatttataacgtgccttccatctctgaaattgctgaggatacataatgtaagaaaacaggttgagggaaagagatagattatgtgtctaggatgggctcgtgtgaggagaaatgaaggaggaggcaacaataagaagactaagagaaatagagatgaagggacagggacacgggctcagagagacagacagagacatggagacaagactacaccccaaaagaaagacagactcactgggatgaatgtgcagattactcatctgttcttccatttaacaaatatttacagagcgcctaccaagtgccaagctctgtgcagtagtaaaccaggtagaccagggcactgagctcagaggtaagagacatagcagtaagcaggcaatttgcaagcaagcacagagagcgagagctgggatgcagtaattcaagatgctccagaagtgcacagatgcaacatacaccccacaccacactccacatgcacaaatgtcccaaaggtagactcatttttgtagggagcgccattcctcatctgaggcatttagagttctgctagcaaagacattcaaataaacgggtttttacaagtatgggcacaaatgggggtgacacctttcagttctcaccctgaagtctctataaaatgaggctgaaggacaggattcatccctcactccagagcttcccagtactctttccccctcatcgggagggactggctttggaaacagagaggaatgtgacctattacagccacaccagcaccactcctctgggctttcagctggaaacttcccagaacacattttgttccaccctccttccatcccatccagacctggcgacctggcccaatgaaggcatcacatgttgccccttcccctgtcttgtggcttctctgctgctgacaggcacatgaaagggaattgaagctcaacagaaaagtgactgcttcctgcacggtgtcggctccctgcctgactcagattcagccaactctgaggagggaaggcaagggacgtttctggatatctcttgcccgggtccctcttctcctaactccagatttagcgagagtccaagctacacaatattcctgaaatagccccaagtcacatcctaagatgggggttcatcccctcatatgaaggattctctttggagaagatgttgggggctttggacgccgtgcactggcacacgaataggaaacgcagagtgacccggagcaggaaggaatgggcaccgccctgcagattctgggcaggctgcaccagtgctgggctgggaaacagcccctgggctccctgaagatctccctggctgtgcaccatttggagcagcagtgaattaatgtgattcaggctccaaaaatagtagccagagcatctaaaattgctttccaccctggactgggccagtcccctgggaatgtcagcatttctaaaatgtccccattcacccagagtgcctttgtcagaccccaagtagaatctgggccaccgttaagctctcctggttccgttggctcctgcccggttcccctctcctgtgtgtcacgtgcactgcctcccaaacaggaaatgctaattcatgcctgccacttgctgttaccaggtccaagaactttaaccctgcaaatggcttggaagggcagaaatggtcccttgcagaagtggcctgggtggctctctatcactgagttgggatttaattcctaacaatgacgactggggaagcaggtcacctgaggaaccctgagcctctggtctgctgctgatgccaaagggagtcatttccacagtggcttgtctttctctgacaaaattatttggggatctcagggaatttcatcatcatgaagacttgtcactctaggcctacctcagtgcttttgcacatcctgtactctacgcaggaaacaccatttacgccctcttccctgactgacaaatgccccttcatcctcttattcagcgccttcctaagagtgctgcggtctttactaagtttgtctgcaatgaatgctctggaatggccacctttgcccaggttacactcccatgcctagagattcacaccctgcattctcctacccactgatcgaccacgactctcagctgccttattcatggacaggagtgaggcaaggaacaagcctctcccctgcctcatggaggctggcctcccatctaacaattaaatggccagagtctgtaaccactgcatggggttcctgatttaaatgcagtttgggaatctctctgcctagagaatcgtgatttgatctttgtgatcatgtcctttagttctcaggttcttagctgtgatgctcgtactgcctcttagtggcttcgctttgcctccctaagagattccagaagcgcaggacacagaaagtgatggaggagtgaggagggagaatgagttagtctacaccttggtttctccctgtgcggtgggagctaacggtttctccgtcagaatggttgagaggatggcatgagatgcgtacatgactcagcacagtcagtgctttggggggcagctgcattttcgcccatgcggtccccagtcccccttcttctggcgacagcagcacatccatcatacttgtgcttgggatgggggtggttgaccccactgtgggattggagctatgacactggactggccccacagaatatcccatgctcccagctctgggttgtaattgaggaatgagcacgtgactcagaccaggccaatacattcagttcggtgacttctgttggaactgttgggggagttcctgctgcaagcgttgctgaaaggagaggctgggaactgcaggtgccacagtgccaccacacaggagaggtcacctgagaatacatctaatgccaaggacagctgagagacaaggggatgagaccgtggatccagccatgtccgagattgccctagaactctcaatgatatgatccagaacattctgctaatttgctaatctaatttgaatccgtttctattctaggcaaaccagaatcctggcaaatgccaagctcaatatgtttggaggttcacccttcccacggccattgctctggggcgagcggtgttccttggcctctgcagagacgatgccacagctcatctccctgtcctcagtctctcgttcttcagtcttttactgcactgactgttctcaaacacaggcttagaagatgccttgactccccactgcctggagatcatgtcccaacttcctcagatccacctgcaaagctctacatctgactctaatttcctttgtgcgtctctcccatgaccttcccctctgggtccatgcatactctgtgccccacccatattaacctcttccccactctgaaacgctccctccactctcccaaccctgtacttttcctgggaagttcctcacttctttcttacctacctgccagatccacaactaccttctcttctgagaagtcttcatggatggccccagactgagtcaatgtctccttctcctgaatcaatgtctcccttgtacatactgtagtacctcttggtgtttatgacttgagagtaatttatacattttttttgagagcagggagcatgtcttactcctttcaggatcccctgggatccttacacaagatttgctcactctagaccctccctgaatttgctgacacaagaccttggcttccagctgacaaactctgactaccccgtcccctcccctcaaccatactctaggagaggggtgcctaaactttgggtcacatttcctcttcaccagtaaacttcttttttaaaaaattatgataaaatatgtgtgacatatgatgtatcattttaaccattttgaagtgtacaattcagtggcattaagcacattcacaatgctgtgcacctatcacccctacctagttccagaactttttcatcatcccaaatggaaactctgtacccagtaagcagtcactccctgttcctcctttctggcaggccctgccaaccacgaatctgctttctgtccctgtggctttaaccggttctggatagttatatgaatgcaaccatacaatatgtgacattttcggtctagcttctttcacttagataatgtttttgaggtttatccacatggtagcatgtatccatacttcattcctttttatggctgaataatattccatcattatctatctctctatctgtctatctatctatctatctatcatctatctgtctatccatcccacattttgtttattcattcatcaggtgatagacattcgtgttgtttcctccttttggctattgtgaatagtgctgttacactgtgatacaacttctgtttgaacacctgttttcaattcttttgcatatagacctaggactggaattaatgggtcatatggaaattttacatttactgggaagctgcttatccttgctttctccaagcctcaacaacatgctgggtctatttaactgctttcacgctgagagagcccaaggttcttagaagggagcgatttcatcttgtcgtctcctgatggcaatccctaaaggatgttcctagtttttaatactgccctcttgctgtttagagctttcctttgtctaagctatttcagacatattatttaatttattcctcacagaaatactgtaaggaggaaacgattacgtctgctttttgatgtggaggctgacagattcagaggatgaagtgatgcggcaaggtcacacagccattaggagcccagctgagactgaccccagcccagtgccctttccacgccaccacagcggccctctctcaatttgcctctcttttcaaagtctttgtaaaatagccaccatctgaaatgtattctcagacccaccattgtttagaaatgccctcttggtaggcaactggttgatgctggcatggacctctgcaaacactctaccagttggcacctcatttgtaatcgaagctttttcctggggcagattctgcctgtaccaaacagaccaatgtttaccttttctgggtcttctgtcaccttctgcaatcctgggttaatgttcccttttgatgctgctatgagtctaaatctgagtgtgtcccacaagctcaacctcagctctctaaatttcctccctgttcttttgttcaacccaaggtcaacccaagagcttccccttccctttctcaggaagaaactatcccttggaccaaggggtcccctgacctctttggagtagaaaagaggcacaatgcccttcagcctgacatggtgaagttgtgtctatactgctccttggaagcttccaatcttagtgtcctagttctacatgagaccaggagactgtagaaataagcaaaacaggcaatgataacaataacaacattctctatccatcagaagcatagagctttttaaaagcatacgattcagtggcattaggtacattcgcaatgttgtgcacctaccacccttatctagttccagaacactttcatcatcccaaatggaaactctgtaccaatgaagcagtcactccctgttccccttccccccaggccctggcaaccacagatctggtgcctggtgctttaggcatatttactcactcaatcccccaactgccctatgaggtggatgccactttgcagataaggaaactgaagttcaatgtgatgctgtgacctccagagtcacagagctaatgggtggccaaacagggattgaagccgtcagagcccatggcttccccattccagcccactgtctgcctctcaggcagaaggtttgtgagctgaccttgctcactgagagctttccttagcagttctgcaagcagcaaggactctctagatgccacgtgatccatcctgtgtccacccaagtaggaataccactaaccacttatcccaaagttgtatagagttctgtacaactccagatctgggtgatgttgtcaggagctctgaaaagaaagcttatgtgtttcactctatttgggaatatcagcgggagataggtttctgtcttgcaggacatctcagagcctttaaaagtaaatgtgcagtataaatctgcaagaaggggtgaaaggatataatgtttcccaaatttatttgaccatgaaacgtttttccaaggagtatctcaaagtgtcctctttaaaactccactctgggccaggcacagtggctcgcacctctaatcccaacactttgggaggctcaggcaggtagatcacctgaggtcaggggtttgagactggcctggccaacatggtgaaacctgtctctactaaaaatacaaaaattggccaggcatggtggcgcatgcctgtaatcccagctacttgggaggctgaagtaggagaatcgcttgaacccaggaggtggaggttgcagtgagcagagattacaccactacactccagtctgggcaacaagaatgaaactgaggaaagaaagaaagaaaaagagagagagagagagagggagggagggagggaggggggaaggaaggaaggaaggaaggaaagaaagaaagaaagaaagaaagaaggaaggaaggaaggaaggaaggaaggaaggaaggaaagaaagggaaagaaagaaagagagggaaggaaggaaagaaagggaaagagaaagaaggaaggaaggaaggagaggaagggagggagaaagagagagaaagggaaaaagaaaggaagaaaggaaggaaggaaggggaaggggaaggggaaggggaaggggaagggaaatctccattcagaaatgccctaaaccctcttaggttagagggtgtccagaggtgagagaggacagtaattatgtccattggccctggagctgggctgcccgggttcatatcccagccctgccatgtgaccttgggcaagctgtttcatctttctatgcctcagtttcctcacttgtaaaacatggataataacaatcttgtgaattatgtaatataaacttcttagaacaatgccttttgtgacatagggctcacaaacattctaataaggtccttggggccgggcgggttagagggggcagtgagagggattatgttacctataatgcataaaactgtaaaactccagataattcatgaaagattacacagatagcatggtttcattgtcctcagggagggtcagtgagttccagtgggaggagaaagtgctatgcagatggtagttagctgcttgatccatcttcctgggtcttttcaagttcaccaggtctcctctacttagggagtgcccgacacctcctggaggcccctcaaattctggtgcctatgagtttcaccacttccaaggaacagaaatcttgtccttttgtcaccacccactactcctgtagggcatactcatctgcccccagagctggagtgctgggagaagctggccctgtagtgtgagggcagagtggccaggctctagcggctgcctggaccatcatttccaatctgagcagtaaatgtctaacgcatgagtcaagtgccttgttaataaaaaagagaataaataggcattccctttagcagtaaatgttttttttaaaaatacaaccttccattaactttggacctgatgcccattctaactgtcaccaaaggacttgaatgggattgtagaaaataaacaataacagctgactcttcaaacacacctgcagtcctcctccttgtcactgacagtgcccagctgtcaattattgctctgagatgggctctatcatgcaactattgggatgaatcactgggccctgtagggtgaatggttcacagatgaggaaaatgaggacttggaaagaagatttgatttgctcaagagcacaacatgagttgaaggcagaaccaggcctacaactcaggaccactgcttatacggtctcttcatttcagcttaggaagtggcaccagggacggatgctggaagaccttgactgcccttaaacctgagaggtttcattcatgcatgcatttgttcattcatttaatgtatctaccaaatacctgctacaaactgccatggtgctagcttcccttaatacctttctataaaaccataatgatctaaccctttttgaaatcttattgtcccagctctactctctcccggcctgaaaaactccaagtatgagtttctatctgttgatgggctgcatgcactttgcaccaagggcaatatggccttggctctgccactttctagctgtgtaatcctgagtgaactactcagcctcacaaagtctccattttctcatcagtaacatagagataatattataacctgtatcacaggatgctgcaaaaatatgagataatgtatgtaaagaacttaacatagtatttagctggtgctcaataaatgacagtaatttacagacagaaatgacagaaagttacagtaataagcacattattattactcttgtcatgtgaaacaagtctctggagattcagcaaatggaatcttcccctctgggactctaaaaagtcaggctctctttgttcatgtgcctaagcaacttttgtgctttataaactataggaatcgtgatatagggacaacttgccaaatgttttcaggtctaatgcaacagatccttgatgtctataaccaaccgtatctttttttcctttctgggaccagctggcctgagaaatagtcttcctctaagtctgataaggtctgtgaaccccagacctgttaggaatgttggctatacatggagataactgcaaggaaatggggctgccctccaatgtattaacaaggtttaaaaaaacccataaacaatggacatggttagttatctatggaagtaacccaagaaattctctgtatatggggttgcagagttgagaggcttaacagacatctctagaaggcaggacagaaagacaactataaataagtgggtgatgacattctttgaagacacttttactttaagcaattttcccttctttagtaagaacccctatatatgagggatggcttccccatgaccacatttataccccacaatcctgtcccctggccatgactgattgaccctgatccaagctggacttatcagattatttctttcaagaacttagagaccaggagcttctggaacctagtcatactgggcctgtggcctgggcagtgatcttcagagtagagtatgtcatccagggaatgcaggatgacttggtggagtataggaaggaaatttaaaataaaaaccttcaatttttaattaaaaatagtaacaaagtacacttccttaatatttaataaacagattggcagtggtgctggttcatgtattgaaaggccagttatatccagtttgtgagctgttgtatggggaattctacagtgttacggaactgatgtagcaccctcatgtatccatttgtttttcctgaagggtgacacagtttgtgtgtgcccaagtaagtaggttaataaaacatatttatctagttttaaccaaacctactatcataaaatgtgtatgcggcttaaaaggtttgtgccaaaaaaaaaaaaaaagtacaatgaaaatacttctactaataaagctaacagtaattctcaaaaaaaaattttacaaagtagtggataaaactgaaaatttaatataataattcaggaagtaaggatgtccctcttccacatgaggtatctgagctggttttcctctgccctccttccctttctccctgccctgccccctggttctctgctgtgtgcttcaggatgacacctatggaatgtataacttgggctcctttgcttgcaggctgagtttggccaagggaccagtaggggatgggaggagagagaggcctgggcctttcctcccttgctccagcaccacatctctggcagtgactgtgactctccttagctacagctcattctggatggaacctcttccctggctccagagctcactagcttctggtaatacgattttcttctctttccccttgaagaagcacatagaatcatgaccaaagaatacttatttagggaaagcaggaaaattgttgacactttaaaaaaaaaaaaaaaagcatgattttcaaaatattatttcatctttcttgttctttaaaaatttctatttttatgttttataaagtaacgcattagtacaatagctcatgaatatgatttataataaagaaatatacataaattggaggtgcatgctaaaaaaattttctctaaactaataagatgcaacatccaaaaaacttgaagacctctcctgtagagaaaaggctggcaaactataaatcatgctgctataaagacacatgcatacgtatgtttattgcggcactattcacaatagcaaagacttggaatcaacccaaatgtccaacaatgatagactggattaagaaaatgtggcacatatacaccatggaatactatgcagccttaaaaaatgatgagttcatgtcctttgtagggacatggatgaaactggaaatcatcattctcagtaaactattgcaaggacaaaaaaccaaacactgcatcttctcactcatagatgggaattgaacaatgagaacacatggacacaggaaggggaacatcacactctggggactgttgtggggtggggagagcggggagggagagcattaggagatatacctaatgctaaatgacgagttaatgggtgcagcacaccagcatggcacatgtatacatatgtaactaacctgcatattgtacacatgtaccctaaaacttaaagtataataataataataataataataataataataataataataataaagagaaaaggctggcaagttcctgctgctgggatctgaaagctgccctgggtcctgccttcctgaggcattgctggctacctaccttttcctttgattttctcaaataccttataataaatcctactttctcttaagttagccaacatagccttctgagatctggcaatcaaagaactttaaccaatatataggtgggatctgcaatttcttgtgtgctgggacagactatgtgaatatcacataataactaccattttatagagcatttttctacagcaaagagaaaggcttgtccaaacttcccagaggaaagaggcccttcctgagctctggaagagtctctctgctgtaggcagaggtggctcatcaggccacatcatagcttaggtgacccacccctcagaactttctgccttcttacctaaatctctatctatcaagcattttggtcattggaaagggtttgtctcctatcatatactggcacatagacattcagaattgcatacttggctgggtgcagtggcttacacctgtaatcccagcactttgaaaggaggctgaggcaggtggatcacttgaggttaggagttcgagaccagaatggccaacatggtgaaaccctgtctctactaaaaatgcaaaaaattatctgggcatggtggcgcatgcctgtaatcccagctacttgggaggcagaggttgcagtgagccgagatcgcaccactgtacttcagcgtgggtgatgcagcaagattccgttcccaaaaaaaaaaaaaaagaattaaaagaattgtatactttagtaatctcagtgctttagcaggctgaggcaagagtatcacttgagtccaggagtttgagaccagcatgggcaacatagcaagaccctgtctctaaaacaaaaaaacgtttaaaacattagccaggtgaggtagtatatgcctgtagtcctagctacttgggaggctgaggtgggaggatcacttgagccagggaggtcaagcctgcaagtcagctgtgactataccactgcactccagcccaggggtcagagtgagaccctgcctctcttgaaaaaaaaaaaaaaaaattgtatacttcagtctcttgtgagtttgattattgtgagtcagtctctacataagcaatcaactaatcaattccaggtcactaaccaggcttagggataggtccaggactctagaacatccccaaggtgatgctccttggggaagtctcttagaagccaactagccaggtttatcttgacaacacctagccttatcatcattgccttccaaactacaacggggaccagttagatctcaggtgggaaacaagaaagatgtcttaggtaagaagcccaggaagacattacattctttctaccatacccatacaagtcaaaaatatgacaagagagtccttggggaaacctgaccatttgggggcatccaaaatagaggactcccatgtgctcaatattaatctgggcttcaataataataattacttattgggtacttattcaggtataagtactttagatctagcaatccatttcataggtaaggggactcagaggttagatcattcgcccacgtcaaacagtaagttgtggggctgggatttgaacagactgggtgacctcggcaacatttacagacttttagggcacaaactttggagagccatagaaagtgactcaagacacacaatgtaggacatggcatttcttgccagtaaaaagcttgtgattctaaatttgtatttttccttctaaatagaggaaggaacttgttcataaacaagactaggagacctgataaagatcattacatactgaaagaaaccaagagaagtgcaaagtagagcaagcctagtggggaagctgctccagtgccctgccccgagagctcaggacctcagctctgagcagcagcactgggacctccagggctttgttcttataggggcaggaacaaagggtcaggcattatcactctgtcctgcagccaggtctataggccacagagagatggaaagagatggggcttggtggtctgatggttttggtttgactctcattcttctcatactagttactatcctccttgaatcagtttgttcacaaatacctcccttgcatggctaaagtacagatttgatgagatattgtataaaatgtgcctggcacatacaaacttgctcaaacaatggtagttcctttcccatatattttctcatctatctgtaagaagtaacccagaagaaaggagttaagagatcacttgctccctgtctggagttgcctaaatgaaacttctgtgaaaaaaggaaaattcatcgccgcagaaacttctagtcagatgcttgccttgtctaaggaaggactctgcattaaacaagttccccaccaggcatctctggagaaaagatgaggattgattaactggaaaagggaggagagggggtgcccatgggaccatgtggcaacccctgcagcctcggccctgcctgtctctcactagggcaggacacaagtcttgccaggtgcccatgggagaccagccttgcaagtgggctttagccaggccctcatagtggtaccccagagtgccacgctcttccacaccaagagaatggctatctgatggtgagttctgagaagtacctgcatgaatagctcagccctccctcttctgtttctctagggaattagctgctttcaggggacacacattctgctctgtttctccaagctttaatatttaaagagccctactttccccagtgggcaccccctagggctgggggataaatctgctcaatgcaatattagaaaacctacttgcctgttgatccaaacactttccaacaccagcttcatcagtcatacgggtgatattagtctctgaattcccaacaagccttaaagcttcagtgaaggaaagaggtgttatttattgggcctccttaaagacttcaccagacacagatgcccaatcctcttgagaggaagtccaccactctccttgcggtgtttttggagttgagaataggacccaggactgtggatggtcagagcctcaaacccagtgcagaagtcttcttgatggaatctctggaggggaacagacaggggctagaaataataagacctaatgtataccgagtgctaagaatagacagtgggctaagggatttagctttgcttttttttgggggggggtggtatttaactttgtaaaatggacactatcattacaggtcgagcattccaaatctgaaaaatctgaaatctaaaatgctccaaaatgcaagaatttctggccactggcaagacactcaaaggaaatgctcactggagcatttcagattttggatttttggatttgggatgctgaactgggtaaatatgatgcaaatattccaaaggccaaaaaaaaaaaaagtgaaatctgaaacacctgtggtcccaagcattttggtaagggatactgaacccatattacaggagaagaaactgaagcgccaacagattaggtgcagctcaagggatacagctggtcagtggtggagccacacggtcactccagggtccacactttccatagggacactgtgctgcctccattacaagatgtcatctccccactgtgataataagggaagagctggccaacactgagcccacctcctgactcagagcccggggttattttcaccacacctgtatgagcaaagtcaagaatgtcttcaggctttcttctcctcctgatgagccaggaagcttgggctctctggaaacaccctcttgatttgcttatcagccacagaactctctgtggcctctctgtgtcccttccctggtggccactctgggaaccacatcccacccctagagccaggctgtgtgcagtgtatagtctcatccctctcagcctctctcattgagcccattggttcctaaattcctgttggttttgctgggatgactcaacttccccaacaccctgcactcaccaatacctggattccaccaagttcatacaacccgatttccaccaagccgtggtggaatgacctgactcatttatacactatgctcacaatttttcccatgcctgtgttttacctatgcctttatttacttaatattctttcatttgagtagcaatgggccagaaaatcaagactgaaaccccggttggccatttactaactttgtgttgttaggcaagtttcttgccctctctgtgccccagtttcctgatctgtataaggaggacaatgacagtaactacttcagagggttgctgtgaggactgaatgagcgactgcaggtaaagcattaggacagtgcctagcacacggtacacactcaccaagtgttagctaccattgtcattacttttatttaaaagggaaactttatattcctaccttaaatggaaaaagcaataccacttaccacaaatagagttataaaaataaataaaatgaaaacggttattaaaccttagctaaggcctgctctcatttttttaagaagggaaacaaacagaaagatggtgaaggcatatgaggcttaaatgagggtgaccaaccttttgaatttgtccaggacctgtcccaattttagcactggaagtcctgcagcaattctcattcccggctgaccctggacagtcggtcaacctacctcaaatagaggctttctctccttcattcaaaggaataaaaagaacttaagaaggaataatgttcttacaatgtgatgttgtgtgtttaaggctgggtcagtatcccacatacgatcatcttgcagaacaagctcacaccttgggccacaccacacaaacccacctctgagagctgagtctccaaatgctataaacctatggaagagccatcatgtcacatgtgccactgagaaagtccccaaagaaaaatcacatttgtaaatgccaagaagaggaacagtgattaaattgttgcacggctaaaatgactctatgttataaaaccattgaaaaatcatgttttggagaatctttaatgatatggaaaaaggattatattagaatgctcagttttaaaaagcagactaaaaaatagcatatacactaagatcctagttttacaaaatatagagaaatgtaaaggaagaaacacaccataatataaacaatacttatcactgaggaatggtattctagagggttttttatttctttatatttatttctgaatttcttatttatatccacttctatattttccaagaaagtctagcaaagaacatgcattacttttttttctagaaaaaactgaatagaaattacaaattacaaataaaaaagtaataggaagaaagtaaccagagctgattaagcccagccttagcagactttttttacatgtcttctccgctaggaaaagttttcagtctggccgggtgcgatggctcacgcctataatcccagactttgggaggctgaggtgggctgatcacttgaggtcaggagttcgagaccagcctgggcaacatgacaaaactccatctttactaaaaatgtaaaaattagccaggcatggtggtactcacctgtaatcccagctacttgggaggctgaggcatgagaattgcttgaacccgggaggtggggttgcaccactgcactccagcctgggtgacagtgcgagaccctgtctaaaaaaaaaaaaaatgtttcctgtccgaccaactgtcctctgctttccacctcccttggagaaagcccttgcagagaaggcagggcttgtccagggtcatgggcgtgagttacctctgctaagactctgaatttgaaggcccatttgtgaggctgccctggactgtcgcctgaactcagagtctagcctccaaggtccacaggactaacatgatatcccctttccctctattcgtgattttcctgtgatttggactgtgacactcagtaactgccccaggacctaagttactaactagcggcagggtgacatctaatgcaggaagcgcccgctttggaccaaggtggcttgagctggagtccaccacctaccagctgtatgcctctctcctcatctctaacatgaggcttaaattaaataacagatctagcacagatcctggcacaaagtagaagctcaattaataccaattttctcccgtttccttttacattcactacctgagaactcagctctccatctccctcctctgactcagctccccaaggggcaggggcagggccagagtctgggggccccaagctctcttctccctatctacccaggcctctgcttctattcagtcagcaaacaatccctctgctgaccaataagccccagagagagcggctgaggggcagtccaggctctgtgaggtgacccaggagaggaggcagggtgagagaggtgggtaacttcaggcccccaccttgtgttctttagggtcaaactagatgaatctgatcatcaggcacatgtacaaaatcaacccagggccctgtgtaaccagaacccactttataagcattgtgtccatttattcacagaaacatgattgaacctgagcacttcgtgtgctcccggcattctgggtgctagacacacaacgggtgaggaacgggataaggtctccgcccttgcagggctcagtctgctcctccaggaggtgtggggtgcttctgtccacctctgttacaaagacttagaggagaaaggcagggctttttagaaagctgaggacccatcacgtatagttcagcccatcagtcaaggaacctagcttcctcacacagacccacagaactcctcatccccaaaccatgagcctcctcagcctcccagggattcagtttcaagtaggtttcacatggccctaacttcctcacccaagatactatttaaattccctgctttgtcacttggtggctgggtgagcttggacgagtcatttaacatcccctagccccactgtcctcacctggagcagtaaggtaaagatacatcccccatggcattctgtgagggggcatgtgaaatccctcgtggaaagcctcagatgcaccatgttgcaagggggccggtgattcccccgctgcactctgacatggggtcccaagcagacgggagctgaccatggaggtcaagagcagagcctccagagaccatggcctggggctgagcatcagctgtgcagtctctctgtgctaaagtgtcctcctctacaagaccagggtggaaagaatgacccctgctttgtagagctgtgggagtcatgagttactgtatgggaaggggaacagtgttcaatacatagtaagaaccatgtgtttgctgtttattttctttcagaaatatatttatggggataaccaatcatgtagtagcagctagcacatggttatccctccaagatgataaaggatacaggaatgcctcccttacctccaagcataaagataggtgcatccgctgtgaatataaacagccacccaccaaatatgcatgcacacacacacacatacacgcactatggaatcatggacagtacaaacatgataatgacaactgttttgtccattaggtcaaaaatcgcaagacacaattggaggcagcatcataccctggcattcacgtctgtgttgagaggcatgggcactggagttagagtcatacaaactcatacagggtttgagtcctagctccgctccatcttggtggaacgaccttaggcaagtcacttaacctgagttccctcccccatagaactgttggggtaggggagtgcagggggatgggcaactccacctgcctcactagcatgtcatcgtccctcggtgggggcaatacaatccttggcaggtcctgactcctttggacccccagcctcacagtcccaggaagcttcctccttttccctgcaaaagactctgctcagaccagatttacttccctgtgccaccccagtgagcagcctgaagagtgttcagcagctgccgagctctgggaggctggagtgctggccaggggtcccagaccccgggctgctgtttactcaaactgcagagcctctatagcctttacaactgtttcctgggcaggagggagcaagacagctgggcctctctctggcctctggcttccactggcttttcctttggaaaaagccagttcaaatggtgctcactctaggaatcgcttcaactcggagccctggaggtgagcagggccgggcacgggccgggcacatacaccccctctagggagcagggaagggcacaggccaggggaagctggagacaaaagaggagacagggacagagataaaaacagggactgtgacaagaacacaggatgggaagggcagagacagaaatagaggcaggcttaaggatctagacaggtcatgccagcccaggttcaaggcagaggggcgtagggggacagagagagagacacaggaagcacagaggggagaaagctctgcttagcagacttgccaaagctgaagaccccactgttgccacaaaggggcccacaggaaagctaggggttgcaatcgcctgtcaggacccacattttcaccctgagctgtgcacactttccaacggcaagcaaaaggagcacaatctagttaagttaggactggcaagattcacttctgatttaaaacttaagacagcaacaataaagatactcagctgaaatgccacccaacaaagccagctcccctggaaagttaaagtttagcacccccatcccagcaccctgtacctttaaggaagagaaggttccctccgcttcccagccgaagaggcaggttattctaggatataggggaggcttacctaaaactgagttattctcctttcctcctctggccagcctctcttcactctggggagcttttaccatttaaggtcaatgttacatctggctccggagctcagagccgagaagcctctggctgcagaacctcggccgcacgcctcctctgagaggggctgggacttagagccgagagctcctctgggagccccactccggcctggctcgggggataatggcagggaaagccgaccagctggcctcagggctcagggcaggctgggcctttggggcagtcgctcaccctgggcccctccgatgggtatccacacagcagatggcagtccccatggcaactcgtgccactggacactgtcctggccggacgggaacaaagggaccctgcagatctccccacccgcctggagcctccagcaagcatgtgagcctggagaagaccctgggccagcgcc

SEQ ID NO: 948 - DNA, 120899 bp, Homo sapiens; identical to SEQ ID NO: 947

SEQ ID NO: 949 - DNA, 120898 bp, Homo sapiens; identical to SEQ ID NO: 945

SEQ ID NO: 950 - DNA, 1290 bp, Homo sapiens
ttgttgatatggactctagaataggattgcgctgttatccctagggtaacttgttccgttggtcaagttattggatcaattaaacgtggtaattcgctttgactggtgaagtctcggcatgtgttgctcggaggtcggattgtgctccgaggtcgccccaaccgaaatttttcacgcaggtttgatagtttagggcctgtggacttgttaagtgttgtttgcgttaatgaattaaagctccatagggtcttctcgtcttgttatactatgcccgcctcttcacgggcaggtcaatttcactggttgaaagtaagagacagctgaaccctcgtggagccattcatacaagtccctatttaaggaacaagtgattatgctacctttgcacagttagggtaccgcggccgttaaacgcatgtcactgggcaggcggtgcctctaatactgagaatgctagaggtgatgtttttggtaaacaggcggggtaagatttgccgagttccttttactttttttaacctttccttgtgggcatgcctgtgttgggttaacagtgggggtaataatggcttgttggttggttatagatattgggctgttaattgtcagtttaatattttggtctgatgtaggcttatgcggaggagaatgttttcatgttacttatactaacattagctcttctatagggtaatagattggtccaattgggtgcaaggagttcagttatgtgtttgggattttttagatgacaggtgtcgagcttgaacgctttcttaattggtggctgcttttaggcctactgtgggtattaaattttttactctctttacaaggttttttcctagtgtccaaagagctgttcctctttggactaacagttaaatttacagggggatttggagggttctgtgggtaaatttaaagttgaactaagattctgtcttggacaaccagctatcaccagactcggtaggtttgtcgcctctacctacgaatcttcccactattttgctacatagacgggtgtgctcttttagctgttcttaggtagctcgtctggtttcgggggtcttagctttggttctctttgcaaagttatttctagttaattcattatgcagaaggtacagggattagtccttgctgtattatgcttggttgcaatttttcatctttcccttgcggtactatatctattgcgccgatttacaatttctatcgcctatactttatttgggtaaatgatttggttaaagctgttcggtagtaaggtggaatgggtttggg

SEQ ID NO: 951 - DNA, 29550 bp, Homo sapiens
cagactaccttttaataaactcaacttcccaatgttaaaaatcactgaatcaaaagatattttcaagcagccttttctcccagatatatattagatataaggaaatcgagtccaatttgaaatgaattttaaaacagcacacaaacatcacaagcccccagcgcacaatataaaatagttctctaaggaatataaacatttagtatattagaatgtgaaattacataggaaaataatctcttcaattagctaaaatcacttgcgaaagattatttattgcacaatttatcagtgggtactaagaataacacagatcctattattctcaacctctaaattcagtacatagtaaaattcattttctcaaactaaggttctatacataatcggagtaaaccctctgttactgagttaggatagggaaaacaaattccttagagttcatgaaaccacttcacaaatcctagaaggcacacattatatttcctatcatagtaagtacatttaagtacttcatatttaaaaaagacaaagctgtacagaatacaaaaagtgtacatttcatccattaaacaaatttacaacttttacgattagttattacagtagaactgacctaacattcacatctaaataattatcacccagttcaatagagcgaacaaagagctgtgctcatttatttatttgataaggctaataacattttatattcacagtagatcagtaagtgtcttggagctcatattgtaaaataaaaaggtttgggccctattgagtcactgggctcattgttaaataactccttgaaaggtgaaggattctgggggataaaatcattggctatccctggaaagatccaaaactctgtaaggtaactctgttcacttttcagaaacattttaaaattaggtaatctgaattaaactcagcaagtctaatctaaaaggacaatttaaaatcttagagctggaaaagatttcagtggatcatctatcccaaggttttcaaaatatgttccatggaatactaagaatctatggaggagatacagggttctgcaaatttgacttgaatttaattaaaaaatttttttaaaaaaaacgactcccactatatgtgtgttactcaccaaattcaaacatgctggatatcaccaatgcattaatgtttttattcattgacttaatcacatttatagtatataaagtttatataataaggaaatttataataatatgacttttatatagtggggtatagggtatgtgtgtatgcacacgtgtttaaaggttctgtaagattttccttgaaaaagtttttgctgctgaaatagtgtgaaaaccacaaataaagtctcagtttctaaagtaagaacacataaacaagagtaagagactttctcaaggtcacacaaccaccaagtgcattgccaggttgatatgatggaacccctggtactctgcttgcataaacctccatagggagtagttagctatttggtacttagctgtcccattatgaatgtcaatggattagtcttcagtatttttgggggcgaaatcaagctacccctggccagatgtttttccttgaaattgatttgaattttatttgctcgcctattaaaatcctactatccagaaattctgtcatcaataagtggcaacttaaattgtgtaccctggtttaggaaaatagtaatatttgcaacttatgaatgataagtcagaaaagttacatggaatgttaaattttaaaggagataggcccttgttttattacatgccgaaatgttaatgttagaaattttagttcataagcaaaaaaaatggttgaggtgcaactgaagatcacaattccattattactatattgtttcagaatattttaatggaaagagtatttcaatggaagtacagtgaaacagtaggaatgccaaattatcttctaattttcataagtattttatgtatatacggtaaaaaagcctcactctattttcttgtgttttttttttgattaggagtctcgttctgtctcccaggctggagtgcagtggtgtgatctcggctcactgcaacctccacctcctgggttcaagcaattctgcctcagcctcccgagtagctgagattacaggcacctgccaccatgcccagctaatttttgtattttagtagagagaggatttcgccatgttggccaggctggtctcaaactcctaacctcaaatgatccacccacctcggcctcccaaagtgctgggattacaggtgtgaaccactgcactggcctcttgtctcttaatctaagaaatttgaggactctgaaatctcagaaagatgttttcaagttaaggaaataaaagcaccataaaccaatattaaatgacctatagtaatttagaaatataaaatttagtatttgtgatgcagaataatttccttctgaaactccaagatgtgtgagcattatcaaagccatttagaacagttacccagctgtgggaaagcatttccagaacagccaagaaaattccccaggagaaatccatttgcaaaggaaagtcacacccaattttgtagacctcacccaaattatacagtatggcaaaaacaaacaaacaaacctttaagtacagtagttccaaaacacactgctaaagttatgaaataattgtggatcatttcaagtaaaaattattaaaggagcaataattaaccacaagggggcatatatatatatactccttagattccagcagaaagactagttttaagtagtaacatgcacgttgaagtattctacattttcagtcacttaaactttcctctctcagatggctacaactttttaatattcgaggtttattttatatctaagtaaaaagattccagaatactcctgccctgcaaaacagtagtgttttagaagcctctggaagtgttgctgttacctttagcaaagaattcaagagctattagttgtaataatacaaatttgaacagataaataataggaaaatatggtctaaaacagtagcaaattttagtaccacaaatggaagacatgggaagtttatttttaaaagggggacaaatgatcagaatagcaaaaataaaagagtggggaaaatggattttcctgtgtctgtgccagtgccacaaccctacattcttcccccatgaccaaatatttgagcccacaatagcaacagaagactttcacttcaaggtcatggcctgtggggctggcctgcctcatcagccatgttaagaatatagttagccatatcatcttcagtgggtgcatctgataccacccaagattcatttgctccagtcatctgtaggcgacaaatagggcaattcctgtgtcgatcactcctattagagaagtcaaaacaaaacagtttgctttcttcttttttaaaaacaggattttatttaaagtaatacatgcacatggcttttaaaaaggaaatagcatagaaatatatagtgaaaaataaatccctccctcctatctcaatcttcaattctctttcccaggggcaaccacagttaccagtttcttatatattcctccagagatagactaagctggattaagcttatgtgtacacacatgcacgcacgtgcacacacacatttctccacttgtcaatatatcttacagactagtatgtatcagcacctgttagagctgtttattctttttaacatacactgtatcgctatgccataatttgtttaactagtctcctgcagaaggacatttagttttttttcccatcttttgttgctaccaacaatgcagcaattcgcatccccatacctaaacaggtaaagtattcctttataataaaaattccttctgagtcccaagaggaaattccctcgcatcaatggaagatttggtcaaagtgtcaagtataaatgcttattcgtgattatttaaatggaagccattactctaggaataacttcttggcagtggcaggggaatatgacaagaagaaaggatattattaattatttttctaagaaatatctacatgactttcaacaatatatctacctgttgcttgcttaaaggtctgaaaaaattcctatggctcataagcaacaggaagacttatataaaaatggagcatacaaagttaaaagataaactttacatgcacagtaatttttctggcaggggaagaactcatatatgatcacttaaataagattatgttttcgaaaaggatttttttctggtcaaacattattttggtaatttaaaaaataccgtatttgagccagagacatattatgcagagaaaaatgtttttcttttcatctctcagtgaaatctgggaccaaagtaattatttgtatcaactgctctttggcttttatgcaaaaatttagaactctgttccaaaaactaaatgtgaaagctacagctggcatatattatttaggttgatttctagttcttcagaggtattttacaagataattatatgtatgctcttctgtgcacaaaacatcacaatttaaaaatagtcaacttctgtttccaaccaacagaggctagatttatcttcccacctaaaattactaaaacaatggtttcatacaatctttcaaataaagcactggccatcagacaacaaaggacagtgatccctgggacatgggagtcaaagaaggtgagacctatacttgcctcagcttacagcctcgagagtttctagcccctgatcaagaagcgggaagcttgatggaacatggcaaactccctgagctgaacacacagagctgagaatcttggggggccaaacagctagggtttacagggcagggtaatggaaagctgcacagagggaaaattccagaggtctacggaagtgtccccgccagaatactcagcagagtgctgatcagtgtgtgcatgtgaagacactaccgaggctgaacaatcaatcaaagggctttgaggggatagtcccctaaagctcactgggcctgggatactgcctgtttcaccagccagactggaaaacctcataactcttggggtatcagtagagttctctaaagggtcttgctattagtgggacataattagttctaaactaaatactgctctggtcctgcctaacaaatcacaaaagcaagatccaaaagaatcaaactgtttccaagtcacttaactatagtccagaaaaaaagctcaagaatattcataggaatacaaaaatatccaatacccaaaaaggtaaaattcacaaagtctgccacaaagtctggcatccagttgagaactaccagacatacaaaaaagcagcagaaaaatataatctataataaagagaaaaatcaatcataaccacccagaactaacacagatattagaattagcagataaaatggaaagttattatagctatattctatatagttaaaaaactagaggaaagctcaaagatagtaagaagagacatgaaagataataaaaacccaaatcaaacttctagaaatgaaaattatctgaggttaaaaaaatacactggatagaattaatggcaagttagacattgaagaaaaatggtgaatatgaaaagagatagcaatagtaactatccaggatgaaacccagagaaagactcaaaaaagaaagaaaaaaatagcaccagtgagctgtgagacaacttcaagtgggctaatacatggtaattggaatcacaggagaggggagagaagatagaaaaaaatctgaaaaaataatggctgaaaaatttccaaatttgatgacaccgtaaatcaacaaatccaagaagctcaataaaccccaagcacaagaaacatgaaaaaactactctaaggcacatcataatcaaagtgctcaaaaccagtgaaaagaaaacaaccttaaaaacagagggaaaaaatggcacattacctacagaggaaaaaaggatgacagagttctcattagaaacaatgcaaacaagatgagtgtgaagcaacattattaacatactgaaagaaaaaatactctcaagtctagaattctgaatcagaaaaaaagtctttgaaaaatgatattcggacattcaagaagagcctatggaatctacaaaaatactaccagaactgatacatgagtttaataagggcgcaggatacaaggttgatatacaaatatctattgtatttccatatactagtatcaatcataaattgaaattttaaataccatttaaaatagcataaaactatgaaatacttggggatagatgtcaaagatatgcaacactgaaaactaaaaaaattggtgacagaaattaaagaagacctaaataagtggagaaatatacagcgtatgtggataggaagatgcactagtaagaaattcactctccctaaattgatatatttattcaatgcaatctcatatgctgctagtgggggtgtaaaatggcacaagactgctttggaaaatagctggcagctttttaaaaagttaaacacacacataccatatgatctagccattccatgtctaggtattcacccaagaaaaaaaccaaaatacatccataaaatgacttgtccatgaatgtatctagtacctttattttgtaatagataaatatggaaaataatctaatttccctcaataggtgaataaacaagctatggtatccacataacagacattactcagcaataaaaaggcatgaactattgatacatgctacaacatgaataaataccaaggtaattagactgaatgaaagaagccagacaaaaaaagcacatattatatgattccatttataaaaattcataacttttatgggtgtgtatatatgccaaaacatattaaactgtacattaaatacatgtagtttattgtatgtattttataaattatcctaaacgctcaagtcttattttgtaaaataatgaacttgactagctgatctctaaagttccctgaggtccagtattcaagaatttattccttctaaacacatacacagaataaatgtagaaatgaggagaaaaaaaggaggaaaaagggaaatgtttgattttagacttaagtcaggcacaaattttcatacagcaaaagaaaagtgtcaaaactaaggtacacccccatatttaataaatgttaggtgtaaaaacaaaaatagttttaaccagtagaaggcatgccataaaattcaaagtactaaagaataaaatctctctcatacttaactacagtatttttgcacttttcaaagtttattcatgtacactatcccactgaccttggcccagcccatgaatgcagtaggtaacttaccatttatcaatacacttctgacaaaagctgtgagcacaaggcaggatgaggtcagcccgcccatccatacagatacaacactcctcctcatcggtcagctgcttcaccctgcaatgtgaaaactgagctgaaacaattatattctctgtcattatgctttatactttttgttgctttaaaaagcattattaaacatctatatgcccacagtataaagcacaatatgactcatgtgcaaaatcagactaaaattaatattatcttttagggatagcaaatatattagggaaaaagtattaagagggctacatttcataaagaaagactagataaaagatacattttgtgataaagaaaacataggcaaaagtggaaatagtcaaatctttctggaaacaatttagcccattttaatcatattggacttaaataaacaaatttaaccgatatagttattgcattaaagacagagatacggtctgagaaactcattgttaggtgatttcattgctgtgtaaatatcatagtgtacttatacaaacctagatggtttagcctactactacatacctaggctatatggcatagtctattgcttctaggctacaaacatatatagcatgttactgtatggaacactgtaggctactgtaacacaatggtaggtatctgtgtatctaaatgtatctgaacacagagaaggtactgtgtaaatacggtatacaagattaaaaatggtacacctgtatagggcacttaccataaatggagcatgcgggcctggaagttgctctaggtgagtcagtgagtgagtagtggtgagtggatatgaaggcctaggacaggagtgtacaatcttttggcttccctgggccacactggaagaactgtctttcttgggccacatatatactaacactaacactaacaatatctgatgagctaaaaaaattgcaaaaaaatctcatgttttaagaaggtttatgaatttgtgttgggccacattaaagcaatcctgggctgcatgcagcccgtgggccgtgagttgaacaagcttggcctaggacattactgtatagcacttgtacagtagtgtacagactttatgaacactgtacatttaggctatacgaaatttataaaaaatatatttcttcaatgataaattaatctttactatagatttttaactttataaactttttacttttaactttttgactctttttgtaacaacacttaccttaaaacacacattatacagctgtacagaaatattttataagcttttttctatttttaagatttatttacttttttactttctaaacttttttcttaaaaactaagacataacacacacattagcctaggcctaaacagcgtcaggatcaccaccatcactgtcttccgcctccacctcttgtcccactggaaggtcttcaggggcagtaacatgcacggagctgtcatctcctttgataacaatgccttctggaatacctgctgaagggcctgcctgaggctgttttacagctaactttttttaataagtagaaggagtatactctaaaatgattaaaaagtatagtatagtataataaatgcataaaccagtaacataattatcaagtattactgtacataattgtaagtgctatacttttatactatgagcagcacagtaggtttgtttacaccagcatcaccaagaacatttgagtaatgcattgcatcacaatattaggatggctacgacgtccacaggcaataggaattttttagctccattataatcttgagaccaccatcacatatgcagtctgtgattaaccaaaacattgttaggtgatacatgaccatataatttattcactatgtgtaacacaaagctccctaaaatatggatcctgccatcagggccttacaatgctgacattgataatgggcatatgagtgaaagaatagtttagtcttaagtatcaggtgctgtgagagatacaaagggaataaaaagcagtttctgtcctccaggagctctttcatcttcttgggaagaaaaaagatttcaaaccttttgctccagccacaattcagagagcccctgaatgagccatatacctttgcagatggtattttcctttcctgaaactgcccttgtgagtttagtaagctccaaccttggtaactcagctcaaaacatcatcatctctctgctctcaaaatcaacacttgcctcaatgaaaagacttaaatattgcatattgattggctggcctttccataaactgtaagctctttgaatatagggtgtttgtcttagattctcaataaatgcttcttgaagtgattttaatttcttttaacctttgtgcttttttgtaatttttaaggttttcttcatcagacatgtattacttttgtaataatataaaaactgactgttccaaagtacagccactagactataaacttcttaaggataggagctatcactaatatgttttccattccctgttgtgcttatagcactgtatgtaagatatttagatagtacttaaaattttgatttgaatgtaaaaataaatgtcaaatgtatattaaatatagtaagtgctaagtaaagaaggaagagatgaatatatctcaaacttgttgaaatgatgagatagaaaaacaataggattttaatagaagacattctaggtgcataaacaaagttgtagaggtaaaaagcaaaatcatgtgtgtttatgtctgtgtatatgtaaccaggaagctggcatgatacttgggtatggaaaactgaggaaaaagattgattagataaagtggagataatctcatccttaaatgtcaaaatattaagtttgaacgtgtcctgacaagcaaactacaatcagtgtataatcaaggggaagtgaactccaactgatatggtacttcaggaagataaattgggagtgcagtatgagggacagtctagaaagaggaaaactggttaggatcttatttcagcaattcatctgagagataattaggtctaagaagcattataaaagacaaatcttttatgtggtaatagattaagtgttatacgttagtaacagggaaaagagggaagtcactgaattggaatgggaaaactgaataaaaacctagatggatatgggtctaatgtatctgagtttctcagtagcagagaatataactgaatctgtacagagtgaaagaatattctgaaggctggactttaaaagtgagaagcagaggactacaaagaagagcattgtggagagagataaaagaatgggagatacagaaatagccagtggaaccagtacaaagttctcttaactttttgctaccttcttagcagcacagtgaccagaaggaaggagagtcttgtgctgtttgttcctgttagatcacctgtagattggaatatttggttctatgcctcatactctgaaaggcacacatactgacagagaaaagaccatctgggaaagcctccagtatgtagacgagacccacataaacaaaggccaaaggaactgggggtgtttatccttgagaacagaaggttcagtgagaatttgatgactgttttcaaatatttgaaaggctggaaaagagaacagatttgtttggaggaattccagagggcacagccattgaaaacaataaatagaatatagtaacaataataatgacagttaactcttatagacaaattattatgtgtcaagcactgttctgagcatcttatgtcttttaattctctcaaaaatcctataaagcatatactacagttatcaacctctgttagaagatgaggaaactgaggaaacagtttgatttgtcaaaaaaatcacacaggagtggagccaggatttgaacacaggcaacttgctgctagagtctgtgccgtgctgcctcaagaaagattttggctactctgaggaaaatgaagcaataggaaaaacttcatagtgattagagccatctgagtatgaaaaggcttgcttttttcaggcagtgagtctcacataactgcaggtgttacttgtacttgcaagtcggacttggcaaaatgtgggtaagcagagtcttgctattcaaagtgttatctgaggatcagcagcattggccccacctgggagcttgacagactctcaggctcctcctcaaaaccactgagtaataaattttcagaagctctgtgtgcaagatctttatgcaccataaagtaataggttagagcacagctgtactgccagacaggcctgaatgtgagtcttggctagaacaatttctaatcatgacacttacttagctaaatctcagattctttggctgaaatgggccgataattgtactcccatatggggttgtgagaatttaatgagtttatacatgtacaacactcatcacaattctataccctgtaagtaatcaataaatgtaaaacatcaatggaattatgcatcagatgtaaagttcaactacataaatatcccttaagacctccttcaatttagaaagtctctttctgtgaactagtgtataagggtattattataaactgaaaaaacacacaaaaacaagaagcacccctaacaagctaatcaggaactgaatttccagttttgagggcacatgaaaagggataacacctttaccttcttcattaagaagactgtaacaagaaaaaaacaatactttcttttcatgtgctaccatacagcttaaatacattggcaaacaccatcctcagcttttaaaacaattaaacaaaacaacaaccactattctggagagaagaaaagcagaaaaatcagatccatctttgaaagattacagaatacaggaaagacaagcctaaacactgcctaccatgttctaaaagtcacttggcctatcagtaacacttgtatagaccaaacctagaaaaccaagtaattctattaaagataattgggaaataataaatggaaaatacagtttaactgtaacatagtgcttgaaaaccagttggttaagaatgaaccagaaaatgcaactgtaaatagagcagtaaaaaaaaagaaaccactggccgggcatggtggctcatgcctgtaatcccagcactctgggaggccgaggagggcaggatcatgaggttgggaaatggagaccgtcctggctaacacggtgaaaccccgtctctactaaaaatacaaaaaattagccgggcgtggtggcgggcgcctgtagtcccagctacttgggaggctgaggcaggagaatggcgtgaacccgggaggcagagcttgcagtgagccgagatcgcgcctgggcgacagagcaagactccgcctcaattaaaaaaaaaaaaatcactgttaagtacattcttaactttaaggtaaaggacacggtgaatatagatttctgctatctacccagtatgacagtaagacaggatgtcaacatgtttggacccatgtaaatctttttccaatgagatatttacaaatttaaattatgatcatgattgtcaaatgtcaagaagtgggaactttcatgtgccaaaagcataacagagaaggaaaagaaagtttagatagaacaataatgtattaggcctgggtaaacaaacatcatcagagaaaactctggctgacttcatttccttctggtaactaagtatatgcattcggttccttcctgaatggactgccaagtcctgaagccaatatataaaattttaatgcttcaattagacattttttaaaaaaagtgggatgattttgccaaattctttgacctaattccctaaaaagctttgactgtctaagaacctaaatacctattataaggaaggtgttaactatctcctttgtcaataaatgcatgcatatagagcggattcctggagaccagtgtgacagaaacattaatattaaagtggccctgccaagccactttaatttagcactgtaacaacatccgaagcacagaataaccccaaaactgatctcagatacaataccaactgagaaaaaaaaaagatttaagatgctacaatgagcaacagcaaaaatattaatagatttcagttgttttcatattagaaaataagtgaaatacaatacttatgcattatataccttcccatccaaagactagcctgacaagatgttacagaggatgagttttcatcaggttcttcagaggtggagctctgtgccaatactcctgctgcttgacttgtgatatctttataaagttgaataaactggtataaattcatgatccgtgatgcctccacaatgccactgcttttgttaatctaaaaatacaaagaacatgaaaaagaaaagttgatcatttctctgaccaatttttcccaaaaagggggaacaaatatttagtcaaacatcctaggaaataggagttttcaggatttgcaaattacataagaaagcaagagtctgaataaatgagtaataccatgtcccctacacttgtggggttcaaacttcttatacaaatttacctcatttaacacacaaaatcaccctgtaagattaattaggcattatgctgttgatgggtaaggtgactttctcagagttaagaaataaattttagagatcagtattaacaattctttcactttaatttcttaaagaatttcttaaccacaggattcatttgactccaacaaccgcatgagattctacaactcaaacaagtactttcttaaatatctttaagttctattttgtaccaaaacttctaaactaaagcaagaaaattactttaaaataaatcctaacaaaaggtggttggacttttcccagaaggccattttgagctttatcaaaaaactcgtttaatatgaggtgaaaccagtggcccaaaggttgtacctttacaggttgtacctctcccccatccagtttacaatctaatgtagaagatacttggggcaagcagaggagattgctttcacaagctttggggagccatggagtgaggcataatgaaatgaccgaggccagtaaggtgaaggtataatgttcttggatgaagaacttgaaatcagagaaagattagagacatgaaagacttcctttcagcacaagacataggatggaagactggggaagaagtaagccatgaaatctattaagtgcatatcagagtaagaacaagcaaaatcagaaaatatttagaaagaaatgaagaatatagggagagagacaaagacacagggccataaaattgtgactttaggttctggaatgtattgatggaactaggggtatcagaaaatgaggtagattacatattttaaaatattattatacatttgaatattgtaaatgaaaataatagttgtaacacgtttattaattgcttactatttgaaaaggcagggaaaaaaatactgagactcaagaatgagtcatgcggccaggcacggtggctcatgcttgtaatcccagcactttgggaggccgaggtgggcagatcatgaggtcaggagattgagaccatcctggctaacacggtgaaaccccatctctactaaaagtacaaaaaattagctgagcatggtggcacacgcctatagtcccagctacttgggaagctgaggcaggagaatcacttgaaccaggaggcggaggttgcagtgagccgagatggcgccactgcactccagcctgggcgacagagcaagactacgtctcaaaaaaaaaaaaaaagaatgagtcatataccatactaagaaattttagaaccatctctaataatcagaaagttgattaaattttgggaaggtaaaatctatctggagatgcaaatatacaaggttctttgtactaaaagactgtacatgaggtagagaataaacagaattaaaaagtaacaggaatttaacaggcttacaaaatagatcttcagagctgaggaaacgggtagtcctttggaactgcatagtacagaagaaattatggaataatccatataaggtcagtacagaaatagcaaagtgtatcacactgtaactattctcatcataggattcctgaaacaagtatttattgagtaccattatgtggatgttattggtactatgtgcactgctctaggcactagccacagtgtgtataaaacaaaatccctgccctcaagcaagttacatgataggtaggagagacaggcaaataaaatacagatacagattaggttagatgaaaataagtgtaatggagaagatgaaacaggggagaaggaacgctgaggggttacagggaaggccttacagagaagttgacatttaagaactgaaaggtgcagaaatgagtcatatagatgtctagggggaagatcattccaggctgagacaacaggaaatacaaaggctgtttaatagaggtgtacctggcaaggagcacagagagtctcacaagaagcccagagtgtttggaacagagtgacagacggacagaggaaggagtggtagatagacggtgaggtgggaatagaatatataggactttgctgatttcagtaataactgtagctttgattccaagtgcatgagaagtcacgggggggggttttgagccaaggagtaatatgatctaatttacatttcaaattgtgatgtggaataggctggttgttgtgcttggaatagactgcttgttgtgctgagaatagacagaagcagggcaagagaagcagggagatcagttaggaggctactggaataatcctggtgatagaggatggtcactaggaatagggtggtagtagcgtagatggtgagagctagccagattctgaatacattttgatgtgacaggactcacttacagattgtcaggtgtgagagacaaagaaaagccaagaatgactctaagaagttggtctaagaaaaaagaaggatgaaataatataattcatgtagttcttaacagccaccttagtacctagtttttaattaatctcttatttttctaatattatttccataaaatattccatttaaacataatttagatcattttttatagtggattaaatattatttaaggataatcatagcagatggcagagagtcaagaaaaagacttaatgtaaatacagagggttaaagtacaatttttttaaagttgtttaacattaagaaatgtgaaactctcaatctcctatcagtttttcatggtggacttgacctctttctaacataaacactgacctctcagattctttcagaaagaacctaaggaatgcaaataaaaaaatttctttagagtagctctaaaatcaagaaaaatcacatgaaaaaatatctaattgcctgtgcctttagtacttttgtttctctacttagaatcttattttaaggaagatgtttaatcacatacagatgttagacatattgaggcaaaaaggaatttgactactaataaaattaaaccttaagtctgtatttgtcaaagagcaacaaaaaacgaagggatgaaaagcctgatatattcgtattcccttagctttctacaatttatattggcctcttcaatgtgagctgagtactttatgaaataaaaatgaacattaagtgtaatttagataatatactgtgtcaataaacaaggaaagcttcaacctatcccagtcatttaaaaagagagtattatttcaacagattttttttgttcacttaatatatactgagttcctactatgtgtaaagcaccgtattacagcctgtaagagatacaataatgaatctagacatagttcctgccctcaggagcttactctctaaaggggagctaagaacctaaacaacttttttcgtaatgcagtattataaagtataaataatgtgctgttggaatctggaagagacaagagaactcctattcaggaagacttaatggatgagatggtatttgaggtggacctttaaagagacatcaggtttagagatgcagaaataaaaggtgtggcagaaactactggctgattatccaaataccattccttcttttcattgccagcagaaccttattttgtttttgtgtccaccattccctgaaatgatgcaggagtcaatcctggttagtctaatctaaaccaatcatgctaatcatattccctctgtcagtgtaggtgtatgaaggggatatgacccaatactgaccagtgagttcagaagtgacatctgctgggtctttaatttaaccaatcctgcagttagtctatagagttaggatttcttgataagtgagaaaataagtattgtttttgtttaaactggtttaacaggaattttccgtgacttcctaatggaaggaatggacatcctagttgagaaaacacaataagcagaagcactgaactggaaaagaaaagtaacaatgatacagtcttaagttagttaagcctgataagaatgcagagcaaaagaaggtcattgtgactaatgcagaaaagatagtttggagtcatattgtaggagttgggactatttggtaggcaagaaggaattactgaggaattttaagcaaggcagtaatctgatgcgagttgtgctttagaaaggttaatctcacagcagcataaattagaatttggagaagagtctagaagtatagagattaatacaaaatctgtgataatctggatcagaagagagagatcagtctgcttgagagcatgaaatctgtcttatttatcatatattcctaatgcctctcacacttgtgctcaaatgtttatctgaataaactggaagcaaaacacagtatgggtaaaactgacaatctactgaggaaataaggcatattatttgggtaacctccagggtccgtgactcaaaggaaaaatctcctaacccagggaatctttatgggtcagtcgggaatgaacttcagagcgctcatgaatgcccaatttatggtttatatgcatatggatgattttgttctttgttttagagccggggtggggataggaggtggcctaataaaattcatgccttcatttaatcaaaaggtttgtagcctcaaaaagttaagaactttctatctgaatctactcagtggtggttgaggctttctaatactcaatgacagctggcaaaaaatctatcccataactaaaaattactaaaaaacaaaaaaactctttcaatggatcttttttctttttaatgaatgaatgtattcttaaaagaaatgatctcaagataacattaatttttaaggtatcatcttagagctaaataggatgtcaccttagcattccacagccagctaaaaacccaaaaacagagatagaagattagtatgatgtaatggttagagatattgaggcaaaaaagaatttgattataaaaacccctgctgtatagcaattagacaactgtaagattcaaacagctagttagaaggcaataacagtaacaaaactatgttttacaaaaccaccgagttattaaaatgtatatgcattatattatcttacagtattaaatatagttctagccaccaaaatagcttaagctcagaggtagaagtctccatcagtctcaccttggtacagaccacccgtacaaccactttccaaaaagcagaggaatcagacccaggttgtacctcaaagagaagatgtttttcctggccagaagccactttagccgttctgaaaagagacaagaacatgttaattttatgaaaaatcatatattaataaaataatacagccatgaaactagattcaagaaacaatttcagagaaggaaatatgaagaaacacaaaaagacaaataataatgattataataactggattcttaaaacagggatagagaatattttgaacataaacatgcaacttaatttctaaggtttttaaagtcaacagcttggtggcatgatatttataaatctctctttgtcacacctatatctcaatggtctttaaatttctaacaaagacatttaggaaaaacaagtcttagaaatcagggacttaaaaaaaaggttggccagggcagtggctcacacctgtaatcccagcactttgggaggccaaggcaggcagatcacgaggtcaggagttcgagtccagcctgaccaacatggtgaaaccccgtctctactaaaaatacaaaaattagccgggcgtggtggcgtacacctgtaatcccagctactcaggaggctgaggcaggagcattgcttgaacacgggaggtgaaggttgtagtgagccaagatcacgccattgcactccagcctgggcgacagagtgagactcagtctcaaaaaaaaaaaaaaggttagctagtgtcatttatcaaaattttttgactgttgcctcagacgtatataaagcatgaaaaacatcttgctcttggttcagtccttgttcaaacaatgatactaacaaacctcttgaaaatttttgttcagataatttggggctacatcaagtaaaacaaatgatttgagacactttatatatagctctactgtcctcccctagcagagtaattttaatttagagagctaaaggatttaaacataaaaatgtatcacttctagaagataattcaatatcatgctatcaacattaatttaaatcagttcgaagacatgcttaagtattgcagttcccttttatcattactaacaactctctctgagcaccagtggggatatcacactcaactaacagctaaataaaatgaggccatcgaaagttaagcaactagccttaggaaacaaagtcttcggtgaaaataattcagccgtgccagtttccagctctgttttctagctgccaagcttcgtcctgtataggtttaattctacagttctcggagatcactgcacgtctgaaatgccaattctgacccatggaaattggttttaagaatcaaatccagtcagaaatatcctgtgctaaataaataaaaggaagacctctgtatcacacagtaagcttagtttgtggatggttttatagggtacattttatctaatacctgtatctttatgctaaagggcaaaacttcatacaatagacagggtttatgaatataaattccaagactctaaaggaatggtaaatgtcattgattactgctcataagagttgaaaatataaacataacaaagcattccactcttatgttactaaattcagaatcctatttttaaaattctttaagaatataatcccagaattaatgctttgcacactaccctttggataatttttaaaaataagtaaaatgctagagtttttaaaaccaatgactatatttttatcataaaaatacataaatacacacagtaaaatgtaaaatctccctctctgcccccttttcccaccatctcccaaccgagagacaagcactgggaatagtttagttcattttctacacacacacacacacacacacacacacacacacacacacaccccacaactatatacagctttttgttttatattgttttgttttaatgaatgaaatccaatcttcttaaaagaaaccatcttctaagataacttttaagacagtctttattcttcccaataaagacagtatgtcttcacataaagacagtatatcaagcttatctaatatgttacagattgctaagcatgtctcttatcacctaacaccatggttgtaatgcctacggagtgggttcatatatcttaccttaaactattaatagtgactacagtactgtaagtttatatactaagtggtcctgaactgctagtcgatttcattcagcctttttagggtttaaggagaggtaatatgggataacaggaaaactgagattcagagaggtggacatgccattaatacctgcgtaatcaacttggccctcagttaaaaggtccaatccttagcagagggccttgcacatactatgtgcttagtgaatgttagctaagttgaagagactaaacagagaacctttaagatctcatttaagaggtgactccacaggttctaattatactcccaggggttagaagatatacataaataaaggtagatgtggatgttgctagaggcagatttaaaagaaagatatgacatctgcccaattgtcaccaagggagaaaataaatagcaaaaaagtcatattttaaaagcacagtggtctgggggcattcaggaacaaagagccctatatattttcatagcttctacatagatcaataccaaaattgataaataaattaacaaatagaagactaagttgtattaggtgtactctttaagaaggcagagaaatttatatttcattttagaaatttagtcaaagagttaagtagaaatttaaaggtgttaattaattagaaaatatgaataaatgaaatatattatttctcagtgatgaaaataagctattactacatatgtattcctctagcaaaatgatgacacagtaaaaaaaagtatatatatatatgcatgtgtgtgtctatatacacacacacatgaatgaattgcttcatgtacagaaaccttctcagtgttacctttgactatcctaggagtctttctctagagtggctaattctcatattccattttgttatgcacccctttagtgctttcaaacaagagtctattggtataaaattgagatgctgggatgtactactgtatcctagaattgcttcaatatgcctgtgctgtgttccaagttccattttaagttctttccatatcttctgtccccattacatacttttaaaaagctacatagaaagtcaacttataatagatactcaataagtatttgttaatgctaactgaaaacattaagtcttaccaatcaacacctctggttatatcttacacagccatgacatatggggcatacatacaacaaggggaaaaacgaaaaacaaaaagagcaagccttacacatcattaagctcagctactctcccaagaaattcttcataagttaaggagccactctctcgaaccaacgtaacatgttttgctactttttctggtaacttgttaataaccaactgtgtctgatccgaaatttgctgtcccatgatgaaaagatgtctttcaaaatccagagtgttgcttcacatagtttctgtcaaatatacagaaaagttacttttacatattatacaaaaacggcaatatactcattcttcaaaaacataaagaaaaactagggatacctttaagtgagagttgagtagacctacatgagtctaaggtagaatttaaatgactctgttttcagattcacatagctaaatgagaaaacaggattcacttatatattattgggagggtgatgaacctctaattcttataattttaccaagtcaaaaaccactaaagcacatgtgcatgtgtacacacacacacacacacacacacacgcattcaagtaattgtatttaagaggaagtttgtctaccttctataattttcctaagaacatttcctgactgcttaccacatgtcaggctccaaactgttttccgtatattatgtcaattacttcttacaacaatcctaagaggtagacaatattacacccctacctatttcccatagacagggaaactgagctaggtgatttatctaaagttacacagctgtaagtggtgaaagtgaactctgaatttgtttttcagattctagtacttacattcttatccactatgacatactggctcacaatatatttacatcagctaaataattttttgttgaattactttatttatagatgtgtaccttagttttaatttttaaaaatatataaaaagacttgtggcttgaaaaacctaagaaaattaaaatgttagatattttaaccacctcacattttctgcctggaaaaagatagctcttttgttcattaactcttttaggtacccccaaaatatatatctaattatcaagtttttaaatgcccccaaaatcagatgcccccccaagaaattctattttatttatccatcaaagactatcattttatttcatccaaattaacaaccatatcacataaagcaggtgaaacagtaatactcttatagaaaaagttttggtaggaagattgctttatcattaatcaaaaaataaagctataaatttaaaatatatataactttatgaagttagtaaccccaaaatatgtaaaatttcctttaggtattaaaatttaatgtactgtatttgaagttaattcctttagttacctaaaataggaaaaggacaattgtaatttaaaaaaaaaacaaaaaacaacagttttgaatctgagcctacttggtaataataaatatcacattatagagataaatgaaaggaagttgttgaggaagatccaggccaaaaaaaaaaaaaaaaatccctgaagtcaaattatatgtaaatatagccaagtggatttacagcaactgtatccaagaagaaacaattaaagatcttagcttagaagaggtctctagggcagtcaacaacagtgattgctgaatttcaaagactagtaaaatctcaaagcaccatggtgttggatacttcttttaattctaagcaaggacagtttccaaaaataaacaaaaattccccaaaacttaacaaaaatctcaaaaagaacttataacctgaaaagtaggatataatattagaaaaaaagtctttcccaagaagggcagtaacttcacaatgaggtataccacatatttaccaggtatactacacattgtccttatttttcttgatcgaatccaaacttatgaaaacatcatcagaagccaagggttgcagactggtattagggagccactgtgttacaggacttttttaaaattaaattcaacaagtagcacgtgcctggtgcttatgttctggagataaaacagtgaacaaaagaaacatggttcttgccactgtggagcatccaatacagtggagaagagacagtaaccacacaaataaatgtataattacaaaatgagaagtgctaggtgaacaagtacaggtgctgtgaaagcctataaaagggggacttgacctagttttgtatcagggaagaagtccctgggcaaacaacattttacttgaggtcagaatggtcagagttagggattaaaaaaaaagtagggaaatggcaaaaggaggacactccaggcagaggttatgaaaagtgcctgagacaggaagcagcacggtgactttgaggtaatttttaaaaaggccacaaggactaaagcagagaggcaaagggagagggaaactggcaccaagagttgggctgtttaacatttttgttgatgacctgaagactgtatgcctgcccaatctgcggatgaccaaaactggaataaatgaatattatctagtgaataataggatcaagactaaaacagacacttacatgctatttaatatgactaaaagttatatcctgaagagccaactgcacaaaaacacatatgtaagatgtgctcaaaagcagttaaaatacagaaggtctgggtttttgtttttgtgttttttaaagagatggagtctctttaaacaaacagagtttgttgcccagtctggtaacaaactcctgggctcaagcaatcctcccgcctcggcctcccaggccgaggattacaggcatgagctgccgcacccggccaagtctggggtttttaatcaaaataagtcaacagtataacgggggcaacaagtatgctaaaataatcctaaactcttgctagaagcaggtatcttgagcaagcagcctactagtccattatgctttgcaatggttaggccacactgaaaagtctgtattcagctctaagcagttggctttaaaggatactaataaattagaacatattcatgggcatagaaaaaaaaagaggtttattctagatagtcatagtttggtaacaatgaagcaatataagtttgtttaaatatctgaggagctgtcatgtggaaaaacaagattcatttacagagaatgggatggccactaagtatagtaagtataaattagaaaggcagatttcagttgatgataagcatgtcgcaccatccagaagtggaaatggctgctacatgtgagctccctctcattggaagtatggaagtgtttaggtaaagattagaagtacatctaataagtgttacagggatttttacctgggtgggaagtggagtaggtgacctttaacctaacattttattcccaaaatgaaactgaaccttcctctaacattcctgtaccaatttaatgaaaatgtaattaagattctagtcaaccaggctgaaaactttgaataatatctacattacttaacaaagaaaaaaactgaacttttgaaatatatagtctcaatatttaatataaatacctatgataatttaaccaacgtggtataggggagatagaatttctctccctctgctctctgaggtctccagctgggcccaagaattaaactaacctaagacagattaacaggagaaaaacacacaaattttatttagtaatttttatacatacacaggagccctcaagaaaaataaggactaaaaaaagtaattaaggccaaaagcttacatagtagattggacaaaggagaagtaaactgtgaaaacatgacaagacacaagggtttgggctgggccagttaatcacagaaaagtgactaggaagataagggttactttaagaaggcttctttgaacacatttctctcagctttgattgcccacttctagtaatgataatgtcttcctcctggcatagagaggacatctttcacatggctgttttatctccagccttcaggaagaattaggagggtcagtgggcacttcttacatctgctgcttttcaatgtgcttttaactcaaaataatccttatgccaaagtggcgtattttgctaccctacattacccaccaaaaccatatttcaaaagaagagttagttgcttatttattgagttattaatagaaaatgatcccctttgtttcagcattgttttcatctgctgccctaactttgagtaaagtttataatttgaggcagcatattaacttgttatcttgtaactgtacttggtatctgggaaacttcatcactaactccttgcattaaaatgcaacagtatctagagactacctgagagagcctgcagaagtggttttcaacctggttccagaaagagggcttgacatttagtttattttgaaaaccataaaatattgataaatattaacatctatcactatatgggtgtgaaaataagatatgactctgtgatctgcatacaatataaaaccacaacacagagtgcatgttcacgaaaacaatctgttgaggccatcctctagtcaaccaccacagcttttcagtgtccctctttggtgactgcacatatttctatcatactatgacattcgttaagtcacttggccatttccctctagtgagcttcttgaggacagcagctatggtctgtcttctggcagatacacaagcactcaatagatgtttactgaataaatgcagtaaataccattggcagtttttgttttattattattcacttagtattcttttgacttttgttaatttggtcagtcatctattagtactaggttggagagaagcagaagttaaaaatatgtatgaaagaaaatgtaaaactgtgaaaatctgtcattaaattaatgcttatgtaaactgggaaacatttactatttgattttaacaagatactcccccctaggccatgcaacagtggtattgcatagaaacataatttgcaaaccactggcacagaattcaacaaaagatgaatttctggtcaagatttctcaaagaactagcagctctcatattattgtgccacctataacacagtcattttttgcaagataaaaatatgctttcaaaaagcatttgaaggattttctaaataaagaactgttattttgaaatgcacaagatcaaggattccaaaaatgccacattctctagtgggtggtacatagtgaatcacttatttttctaacaaatgaattgtggaagttcaaatattccttataaaaatattaaaattacatcatgggtaactggcaaagcaaaaacgaaaaaactgctcaaaaactcctaaaaatttaaaccataattcattcataaaataactaaagcaaaatggaaaaggctgaaaatgcaccaaaatgactaaatgacaagtactgcactgtagtattttaaaaacctctctgaaaccagttctccatcaaattttgtatcaacctcacctaaaaggatttaattgaaataaacatcaatgattttcactgtcaagtcaactttaacatcagtaataaataccaagtactactgactgggtccctaaggatattatttactttattactcattgtttactcaaactgtagatctgtaaacagatatcaacttttttttttcaagacaagttaatatagatacatagtgaaataattaggccagagtcactatagagtccagaatgcctgttccagaatcaaagatcttgatcagaaaaagatacatacatatatattagagagagaaggagagagaaactacaaaaggatagagtgccgtactaggagattaagaatatggatttctcacagtaacagtgtgtttactaaatgcatttcatattggaaaaagcatattagacttgtaagaattctctctggacctcccttgcctttttgggaaggaaagcgtgtttgtatttagatgggaaccaagaaggatcaggctacacacatcgaatataaagttcatttacaccaaatgacaaatattaatttttgaaacatatagtcatattcttgagaaaaagttctagaaactgaagtcaggcaatgtgaaagaaaaggataaaaatccatactatttttgagctctgaattcagaaagcatcacttctcagacgggtgacttcgacatggaggtgactaatttaggatcgtcggccggtggcagctcatgcccccagacaaaattctgaatgggtagaggtcattttatagcaagaagaatgggcagaagggagtgaaaacgaataaattcgtgctgaagatgtaagaattataaacaattgaaagtgttccagcagctttatatatatgccagaggcaagaactgaattagctggcaccgctaaataggacagtgtcagaatataaaaggtacactacctttaataaggggcatagggatcgatttcaataacaatcgtaaatccacattttgtaacgccgagacaaataactgaaggaataatttcaaaagctaacacagaagccttctgctcctgctgtgtaatcactaccttcttattattagcaagaaaacgttcttttcttagccgggtctcaaggtagcagctagtttgacaaggaaagacctttgggaagggtagcagcctaagccaattcataagtgtggggctggctaagtagatcgacgtggctatttctgagctatcgtcccaggcaaaaggtttcttatttgggtgtccagcccggcggagaccgagcccgcgggccaccctagcgctcgctctggctacgccgcctcagcccctcctcaagcgcacctggacatttaaccaacagctaagtccggcggccgaatgactgagccggcggcaatattcaaacaaccgttttgggatagagaaggaaaaactctctccgggtccctcagaaccaccccgaggcgggacaagccaccgccaccccgggcaactggaacccgccgggcagaagacgggcgtcaatagaatggcctccccagccgtccccacgccccaatccgaggcccggggagggcggcggggctaggcctgtctccccgcggaagcctggctcggcagcggagggccctctggggtttctcttcccagacccagagtcctggagcagctagcaagggaaacacgaaaggacagcgccgcggagctcaccccaggttcaaggcatcgcgcaccctgcggcagcggctgcgctgcctcagcccacagctcagacctgcgggtggccgcgactcaggccgggacccggtcgcacctc

SEQ ID NO: 952 - DNA, 515541 bp, Homo sapiens
gtgggtcatgctttgttttattcttgaacctttagtcccatgtatgaatcctgagtgttaccctcctgaatgctgtgcactacagaatgaactttagttcacagtaaatgagggatgctttttcttaagaaataaatttaattcaaggtggttagtgaatgtgaggcaatgtaatgccttcacgaaagttaaagtaatccagttacaaaagaagcactgtgtatagtctcaaatagctgaaggtacaatgggctccatattttacaaagtacaaaaaattatttcatatacaaagaaaaatacaaataatgtgcaaaaaccattttcacaggtggcaatttataaaatggaaatgatagaaaagtccttcattcttaattatccccagatttcttatatattaacacagttctatttcctagtgtgtggacaattttaaatttgaaattctgatttatttttaatctacaaagtatttttattttttaaaagggaaccatttcattattgaaatcttatgaatgcatcagttaatttatattaaattataagcaggctatctgaaaaacaaggatatagaaatcatatatacacatttttgaaatattagtttagtatttaacatattaacatttcaaaacaaatgcaatgatctagctacctatgacgccagctggtgtcagtggttgtagcgaagatgctgtttctgtttaccatgagcaaacagcatttcttgggtcttaagctaaacaatcacaagttatcaaagtaaagaaaatctaaagacagttcttacttttcatgtgtagaagtgtagtttgggtatccagtcatgccacagtgtgactgtggtcaacacagcccttgtcacaggtgcgtatggtcctaaatagctggcctctgtctttccaacatcttcacttcattgggaattcagtgcaagtgtttgttttgtgagttagtgcattcagctttttttgcatgttattttgaaaaagaagctgtcaggaagcagaagatacataagaacacaaggccctggatcctcagagcacctctggtctagagaattcagtgttttggaagtagtgttttcctgcattgggctggtcattgttgtaccattccctggataatctttttccatcagaataatgctgtgtgctccctctttgcctgctactgaacaatgacgtctcttgttgtgaaccccactggcagagcacggaccatggaagcatcttttggcagcaccagagaactgagcatctcaaaggtcaggcattacaagtagatgtctctcataggaaacctagtccaggtagaatatgagacaatcttggagggttttgatttttgcttgttaaacaggtctccgaggaaattatgacctcagagaacaaaaaaggatctatagctttcatgaagaaggacccaagtaggtggtagccattttgcctgggtgaggttcacagttggctcaggagacatcttctgatcattaaccactaagaccctgttagaaaaatttagtgcaagatacagggagtgcatggggctgttgaccagacctgtgtgaaacacctattcaggttaagtagatatagcaacccctgcaagaggggactgggcaggagaacctcaggccctgggataacttgttgtcagctcctcaaggatccatgcttctttttctatctatctggcagcatgagttcttctgtttcttctgcgtgggttgaccatgggcatcaggcatcagagatacaactctggatcttgtccatccattgctgggcactctgtccatcctgggcgcagaagttatacacacgtttgctggtcttgagctacaaaaccaaatgacagtgaaccagagatgaagggcagggctgttttatggatttgggtaagtggtaaatcagttcctgtgacctttcttttccatactgccccagaacgtctgtatgaatttttcttcctcaactaccatactgttattgcctttacttttgtggtctctagagtcataggggatgttgatagaagggtactggcaggaaagggagacacactgggagcgccttattttgcattttcttagtgtcgtctttgactaaggaggaagggtcagcaatgaatggtgcctttaacctttcccatgcactgcaccaatgcactgaaggtgagggagctccttgtgctccagggggatgcctgagattcatgcataccataaagttggccttcgtgtcccctttctttagttggagccatattggaagcccactgtcaggaaaacggtctcatggcctgagcagggccatagaggatgacctatcctctttataaagccctgcttgactccagggactacataagtctccttctattatgtggcctataaagtgccccatggcctacctaagggctgctgaagatgttagcgtagacacttatcatgtgtgactaaggacagtcttttgtgggtagtcaagcacgaagaccactgaatactagggaaatagcatctgttcttgaaagtaggtggtgactgaaataactaacaacatttaacaaggagttcatctgtttccatgtgcgctggactccttttgcacaaagcaatatgtagcttttctgagacatacagacaggaagagaggatagccttgggggtcaataatgctgagttcaagctctggaacaattcccatagccaagggggtctgtcatccatctgtagtcaccaccaattactctgagggctccatcattcttggagacagacagaatgatgtgcagacagagccaggaaaagagaagtaagatcaacttacatcaaagaaagccttgtcacttgtgtgctttggggctcccatgctggggccagcagggatgaccatttctacttcagccagatcaatgtggcctttacagcttgtgtcctcacctgagtcatagtagcgcagctggaaccaaaaggatacaagtgagatataagagacagaaagagaaaatgccatggcttttcaaactgcatttgaataccttcctctgtaccttggttatatatgctgaactatgcctcgaagaatacacaaaaaattaattaataatacttgttgcttctaggaagaactaggtggcttggagaaagcattgggggaaagacttatgtactgtttgaaaatcaaacaaataaatgtattacatcttaaaaaatagaatcaaggctgggcatggtggtttatgcctgtaatcccagtcctttttgggaggtgaaggtggacggatcacttaagcccaggagttcgagaccagcctgggcaacatggtgaaaccccgtctctacaaaaacatacaaaaatcagccaatcgtggtggtgcatgcccgtagttgcagctacccaggaggctgaggtgggaggattgcttgagcctgtgaggtcgagctgcagtgagctgagatcctgccactgcactccagcctgagtaagaccctgtctcaaaaaataaaaaaaaaaaaaagaagtcaagtaacaactgtaaaaagtatatgtaacatataaaaagagggctaatgtttagtaatatacagaattcccagaaattgataagaaaaagataaagtagaaaaatgctcaaaatatctcaacaggcgagtcacagagaaatacaaatgatctataaacatctgaaaagatgatcaacctcattaatcaaagaaaaataaatgacaataaatgagatttcacttttggattgagaaatattaaaaatggctgatgatatccaataaggtactagatcatctcaaatactgccagtgtgaatataatttgttagaaattttttggagaacaatttggcaatatcaactaaaatttagaatgtttatgcctattgaaacatctttccaggccgggcacggttgctcatgcctgtaatcctaacactttgggaggctgaggcgggtggatcacttgaggtcaggagtttgagaccagcctgaccaatatggtgaaaccccgtctctactaaaaatacaaaaattagctgggcatggtggcaggcgcctgtaatcccagctactcgggaggctgagccagagaatggcgagaacccaggaggtggagcttgcagtgagccgagattgcaccactgcactccagcctgggtgacaaagcgagactctgtctcaaaagaaaaaaaaaaaaaaagaaaaaaggaaaaaagtcaaagagactgctagggaataagccttattgggccataatctgtggatttcactctctagtatacatggcaagaaagtggtgcttctgataccgtggctctgacctgagacttttctctgtctctcctctcaggcatggtatgagcagggctaagtggaaaaaactgtatctatctttcatgttaaagaagtccagaagactggtaagaatgcaagtgtaatttgatgtaaattatagaaaaattatgacattctcctatgttatatttagaagcttaatggaacttttttacacagtgtaggctctatgatttcagagtatagctccctaacagggcttccatttgtatatttgaacataaattatctatctatattgtcccacaaagactctgtaatcgttatgaaactccttgagcagaggaaaagctggactccaaatacagtcttcatttggaaggagtcttttagatgcaggtccaaccaaagcactgtacaggagtaacagttcaggtttttcctaacagattccattttatagataaatgcattgagaatcaaaatgtgtaagcctcagcctcaaggctgagtggtcagtcccaaggtggagttaaggcctgcagtcagaacacaggagaccatgcagctctcagtaatgcagggtgcagagttgctggaggtttgggtaggaactgctctcccttgaaatcactggagtaaagactatgatgctaaggattgcagaggctgctacaggaatagctaagaacctaacagtagtcaaaagatttcttgacatagtcagcaaggaccagtctagtacttgcccacggtgaattccaagtttgggtgggcacatccccttctgccgcttttggggcccctttactcccctgttgctgccatctttgaagggtaacagtgcctcctttagtaaccagtacagcagtgggcacagaggtggtgttcgataaatgtttgtagaataaattaatgccctctgttttgaatggatgctttctgctgcgaggacgaaggtaacttgtattctggggagtgttcacaggcataggcttatatgtgcatgtggtatgtatgcaactggctgaaaacctcaggaatcccctcacctgggtgttaagatcaggcagcaagagatatttgagcattaaaaaaagagttctattgctctatgctctgggctcaattgttgctgcctctgcctgcatgtaccaggccgagctacttgggaaactccctcagaaggctattgcccttactcagggacatctggggcccttgaggagcctccagactacatatgagaggcactaaaaaagcagtctgtacatgaggaatctatctgtctgctagagccacataatagccagggactgggactagcctagacagaagtaatttcttttggctttaagagtattacctgatgttttgttacatccaaaacaaaccaacggggcttccaacctttcagcaaagcccctcttttataaagtgttccctcaaaggacctagaagaaatgatgacaggagagttaattttgatttacacttacaaaatgctgtaaaggggaggggatatctgttgtttttgtcaagtctctatttcccctagatgattcaaaaatggcctataagagttctccctggattttttctgctagacctctggggaaagactgctgctttctgctgggattaccacatctgtgaggcttggaatgatcagtagccatcctttgtgccatgttgggactgacataacacagagagagggcaaagcagagccaggaagtggatagaagatactgtgtgagaagctagcatacccttggctgtcctagcttatgtgagtaaattcctttttgcttcagctagcataagctggatttctgatgtgtgccactgacaaagtgctggctgacacatgttccctcaaacgttctggcagacaggagataagagccatcaggactcaactacaaataactacaacctcttcgaattatttttagttgtaatttttgttttttgtcttttcaaagaaacatctaaaacattacaaaaattaaagcaaatccatttcaagtttataaaaggctgtactgcacaggcctagcttattgagggacctgtggtttagcctcaggtgctgtggggaagtcttcagcacagcgagcagggttcagcatgtcacctgttttcatcattcttggatgtatactggctatagagcgtggctgctcttcgctccactccattggatggggagatgctggaattctgttcctcccccatgctgctgtctgggagatgtagcagagacctcttctgataggaaggtaggttggtagacacaattcctggggatctcgacaggtgtctttgggactgaaaaagacaggacaggagctaggaaacctttacagacacttaaactactgactggaaaatttcatttacaaatatttatctcaaggaaaaaactggactaataagcaacaataatgtacaaaggtatcaatctcagagttagttatcgtggtaaaaaactggaaacaacctacacgtccattattagggacattaaacaaattatggcatttccatacagtggaattctagacagccattaaaaaatgatgctgctatgaccaggcgtggtggctcatgcatgtaatcctagcactttgggaggccgaggtgagtggatcacttgagtccaggagttcgagaccagcctgggcaacatggcgaagccccatttctacaaaaaatattttaaaaatgagccatgtatggtggtgtgtgcctgtagtcccagctacttgggatgatcaccagaaccctggaggttgaggctgcagtgagccatgatcacgccactgcactccagcctaggtgacagagtgagacactatctcaaaaaaaataaagatgttgatggttttttttttgagacagggtctcactctatcgcccaggctggagtacagtggcatgatctcggcttactgcaacctctgcctgctgggttcaagtgattctcctgactcagcctcccaagtagctgggattacaggcacacactaccatgcctggctaattttttgtatttttagtagagacagagtttcaccatgctggctatgctggtctcgaactcctgacttcatgcctgcctcggcctcccaaagtgctgggattacaggcatgagccactgcgcctggcagacactggtttatacacagtgacagttggaaggacacgtatgccaacgtggagtgaaaaagcaggtttaaaatagtatgtctagaaaatctcttttatatgtgaatttataagggtaaaacaagtttgatagcatagtggtttacttctaggttataaattatgggtgattctcatcttttataactttctgtgtgttctttcaaaaaaatgaacattattactttcattattagaaaaaatcaataaactattatttttctaacaaaaaagcattaaggcatcacccacctgttgtctgtctgataacagctcctgaattgctatttgagggtaagagatagagccccagatgttctttttttaccacaaaggttttcttctaccctccattcttcttgacctttctgtaacatctgacctgctggcctcttcttcctgaactgttcttcagaacactcatctgtcctaatttcccttctgttgcatttggagccagtctgatgtgggttcgattggtggctctaccagttgccactgtatgctctctgtgcctgttccttgtgtaggagagggaacgccattccctcacagtggattaaataggatacgaaggtgtgtactgtactaagcacagacccttccacatattatgtgcttgataaatgtttcttaaatcagaaataggaaatggggtatgagaagcagaaaacagagtatttggttttaaaatatatatatacatttttttgagacggagtcttgttctgtcacgaggctggagtgtggtggcacgatctcggctcactcactgcaacctccgcctcctgagttcaagagattctcctgcctcagcctcctgagtagctgggattacaggcatgcgccaccacacccagctaatttttgtatttttagtagagacggggtttcaccatgttggccaggatggtctcgatctcttgacctcgtgatccgcccacctcggcctcccaaagtgctgggattataggcgtgagccaccgcacccggccgttaaaatatttttatgataaatgtttcttaagtcagaaacagaaaagggactgtgaacaacacagggtagcatattttgttgttttaaaatactttctgtggagcaaacgtggtcttggcattcccctcctgccttatgtggtagaagatcagctgaaaccacacgggcactgagatagaaaagaacccaatacttttccttggattcggggtgctgagacataagtattatgtcactgtggtgaagtgagacactcaggaagtattcagtcatttggaactttctgccctggacctccaggacatgacccctcccctttccacccttccttctggccataaacccagctgggtcttgtcacctgtggcagcaggctccacctgacttagcaccctcagaaagctcagaagtggctctcaaggggcattgccaactcacgcgatctgttcttggttcttctttaaggtccacggttaccctttcccacagctgctgccacttctcaggggcttggttcaatttgtgctccaatttttcaatttcctgcaaagaaattaaaagttttctgatcagtatttcatagaaatcaggatgggccccaaagccacactgcttctgtactaggcccagatgagcagcatggccagagggcagttgaggaaagtggtggacatgggcctgtgaggtctcccagccaggaatagtggtgagagctctagttggtgtgccgtactgtggcaaagatggtttattaggacctataactaggcctttttgtacaggatagcttacatactaggatgtgaaatatgtatctcagacatctgcacccttgggcagcccatgggaaatctgatagccaaagcaagaggtcaagcactggcccgtggcccagccctaatagctgaggtagatgagaagccagtccttgacaggaggaacccctcaactctgatgattcaaaccagatgtggaaagaatgaaccaagaaatgcccaaggaaacagatataccttctgacagggaagctggaaatcagggcagctgcctctgtgactgtatgaccactgaagcatactcttcctggtcaggaagccagatggggaagactctttaggaactgtctggcccatatcagggctcaaagctattcctcaggctggctactgccaggaggggttggttccggaacattccttgcagaagatggttgacagcactcccatcaggccactgactacccacacttctgaccagaggaagtaaagcacccacagaagccacagccaagacctgactaaggctgctcgggcaactaaaacagctgggaagctgctggaaggagtaaattgctctatttgcttgattgctttcttgtaacgctggaaaatcacttttttttttttttttttttactgagacggagtcttgctctgtcacccaggctggagtgcagtggcgtgatctctgctccctgcaagctccgcctcgcaggttcatgccattctcctgcctcagcctcccgagtagctgggactacaggcgcccgccaccacgcccggctaattttttttttttttttgtatttcttagtagagatggggttttactgtgttaaccaggatggtctcgatctcctgaccttgtgatctgcccgcctcagcctcccaaactgctgggattacaggcgtgagccaccgcgccaggctggaaaatcacttttattgagactcttttccagtagtgaagcctggtcccccactgatgatggggagcaaatctggtttcttcataaccataaccctagctcagagtaaggagagccatgttcagaagttacttagcctggttcctttgccctcatgcctccagggcccctggtgcccctaggtgtgtgtctacagttgacttacactgaaaaggctggtgagagcatcaggctgagtacagctgacatcatcatagcatggccacactgttctcctctggctccgtggcccagcttctccagccaggtcagagtcttcggaggggaagtgcttgggggttagcatcatccagtcataggaagggcctgtggacagggtctcttctatgtagtaatcccacttcttgaggctagagacgtttacattgggctttagagcctgttaaagaaaacagaaatatagtttcatcttgaccccaaagtaccccaagctcactgtcaggcaaacccctaacatttatagagtccaggggaggaagagtatgaatggagttcaaataccatatttctaaatatttaaaaatcatacatcaagataaattattaaataaaacattctccaatcctccctcctacattgagaaatgtaacttcctaatgacgtagaaggtcaagttcaatagagaattcttggattcctcagaattttatactaacaagtggtagcactggaggagctggccccagccccctgtccttggcctctcttctccacccacccctatcttacattctaagggtcttaacatgaatcattatgtataccccagcccacaaagtcaaactctgtccactctgtcaaacctgctactttttgccattctttgggccttggggtccatgcactgacttaggagactgacttggagaagtagcctggtgagcagcctgaatttgggcaaagaattctgaagtacccagacagagtatggtttagatgaaggaggggcatctaagcatgtacctttggtttcttgtactgctcacctccatgaggaggatgcagctggaggaaggccagactagggttctatgattggggcccaggggaggggcctctcttggccctaagtaatggtggaactgcttatcagaccagtctgttgcattccagggcgtgtgttatgtagatgtgcatggtggggcagttgccccgagatatgttatccttcttgggcttggctccgaatatctctgcttcctacaggggtccttccatggctttggtacagatgaacttaaagaaaccttttctaaagtattttaaggtttttcagcttagaccacctgttgatatttcaaattttgttagttctttctttctggggaaaggtgccttgctttgattctctgcaagttttcccttctaggttttgagagccagctcctaatttttgtggcaagaatttagggaacagtctccatttgtgtcacaacccaaacctatagtgtctcaaactttgaaatagctttttggtatgaaacctagtccaatgtttataaaaagcttaaactgcttatatatgttaaaactaaggaaaaccttaacacaaaatttcagaaagtgaaacataaatgatttcttactctacctctatttccaatggtgaatataaataattaaagaaaatgggactcctcttgtgcattctgtcaatacattcccaaatacagactccttttttggcatgcttttctcctttatcatcaaataaagttcctgtagattaaaaaaatccaacaaaacaaaattaaataaattcacactttgccaaaaaacgtatgatgcatgcagcagataaaaaagtggaatattttttatggctttaaaaacagcaacatttgtgtgaaaaccttagaaaataactgcaaagctaaagaccggaatgaatttcatcgctacagggaaacagatccagatggaggaaacatctgataaagtttgcctaagcagccagcagtctatcaatcatgactcttccaaccctcatcctgcatctatatctagattcaaagaagtccatgcaggaggcagtctacacttttcaagagaaaatggaaggacttcagagttgatttgatgaagctcagtaaaaaacataattttatgtttctcttttaagttgttggctgtttgtttattatgaagccatttaaagagttttcttgtttagcagtgtatatatactgcagatcatggttactgagactctagatgacagaagcgtgtagtctgtgtccttgggtgacttaaaaataaaagcagaacttttatacctttttcaaatagtcaatctattactaacatgagcccactttgtttttaatagggaggaaaatgtgttggggtgaggcaaaaagtagttctttaaaaggccatgaagggtgtctcagcagtggtgtcttgcttggaatgaagtgacatagtcaaaatcaacatgcattttaccagtttatcaaaaaaaaaaaaaaaaaaagactcaagcccaagatggcatgaaattctataatatgtggggcccctaagactaattaacagtttcttctctaccttttaactgcagggtccagtgcagtagttctcaaccttggacatggatttaaaaaaccaagggctttaaaaaaatcccagtgtccaggtctcacctcagaccaattaaatcagaatctctggggatggcccgagatattagttattttaaaagttcaagtaactccaatgtccaaagttgcaaatgctctaggggttgcagtaagattttgaaagccaccttgtatattgctccatttggcgccttgaggcatggattagactgaaaggctgtgtggtagtcagcccaagttgaaataggctctaggcacctttgtagacagaaagagaatgagctgaaaccagaagaggagatgcaatacatggccctctgttccttagggctgttgtaacatcttgtaattggaaccaagtccaatggacttttcttacagtatccatatggctggcttagggcaacatgtacacatataaggaacatcttaaaaacagtccaaatcagacagctagtgccaaatcctatcaaattataaccctataatccagtatgtaataatcaacatattaagcttttaggacacaggagaattcattgtgtttaagtttttctgataaaatcttaaaaattatgactcagcgtggtgcggtggctcacatctgtaatcccagcactttgggaggctgacgtgggcggatcacttgaggtcaggagtttgagaccagcctgccaacatggtgaaaccccatctctactaaagatacaaaaatcagctgggtgtggtggcgggcacctgtaatcccagctactcgggaggctgaggcaggagaatcacttgaacccaggaggtggaggttgcagtgagctgagatcgtgccactgcactccagcctggcgacagtgtgagactccatctcaaaaaaaaaaaaaaattatgactgatgaattctaccagcagtggttgagattacttactctccacttcgtcattttggcagatagagggtagttaccacaggtgttcctaaacaaggtttcactgtaggcctgataacgagtgcatctaccagaacacaagaaggaacagacttcaagtaggcaacctagtctggactagggacacgaaactaggcttccttgatgttgattaggtgggtggcctaacatccagagaggaggctgggtagatgatttctactgaggcttcggcaatgacattctaggattcgaaatgcatgtttatgtgttgttgtttttgagacagggtctcaaccctgtcacccaggctggagtgcagtggtgtgatctcggctcactgcagccttgacctcctgggctcaagtgatcctcccaccgcagcctcctgaacagctgcaactacaggagtgcgccaccacacccagctaatttgtgtgtgtgtgtgtgtgttttttttttttttttttgtagagatggggttttgtcatgttgcccaggctggtcttgaactcctggggctcaagcaagccgcccacctcagcctctcaaagtgctaggattataggtgtgagccgttgcacccagcctgtgtttatgagttttaagaggaaacatgtttcataggatggaaatgcttatattttcaaataatcatgataatctttcaatatataccaaacatatctttttatccgcatcattgtatttaatcttttcaacagccctgtgtgataggcagggctgtttagtttttcagatgagaaaactgagactcagagatgaagtaatttacccaaagttactgacattttctgatccttgatctacggctctacccgtgggaccagtggtgggtctcagacttggcagcataatgggctcacctggggagtttttattttttattctttatttttgagacagggtctcactctgtcacccaggctggagtgcactggtgcgatctcagctcactgcaacctctgcctcatggggtcaagaagttctcgtgcttcagcctcccaaatagctgggattacaggcacatgccaccacgcctggctaatgtttgtatttttagtagagatggggtttcgccgtgttggccagactggtctcgaattcctggcctcaagcaattcacccaccttggcctcctcaaagtgctgggattacaggcgtgaaccaccgtgcctggccttacctggggagttttaaaagctgttgatgcctgggccttaccatcacagattctgatttaagtggttggggatgttgcctggaccttggaagttttaaaagctccccaggtgattctaatgttcagtcaagtctgagaaccactgcactagaccttgttgcttctctaatgaagagaaccatcatctgctataggagaagccttggtctttggccacatctgcatgctgctaaggtaatttgctgatcagcttaattcagcaaaacaaactgctttattaaaaaaccaaaaacttagcctgggcaagatggcagaaccctatgtctacaaaaagtacaaaaattatgtgggcatgggggcacatgcctgtggtcccagctactcaggaggctgaggtgggatatcgcttgagtcccagtggcagaggttgcagtgagccgagatcctgccaccgcactccagccggggagacagaggagaccctgcctcaaaaacaaaacaaaacaaaacaaaataccactgcccccctgcccacgaaacaaaaaaacaaaccaaaaaaaccccaaaaaacacaactactccaaggaggcaaatacctgcgttttactcccaatatttgtacatgttgttcctttcagtgataaagctgagtgacatggtgacccctgtaggtacaggtcagtccacttaagaccaggcctggccaggcgtggtggctcacgcctgtaatcccagcactttgggaggcagactgcttgaggccaggagtgcaagaccagcctggccaacatggtgaaaccttgtctctactaaaaatacaaaaattagccaggcatggtggcacaggcctctaatcccagctactagggaggctgaggcaggagaattgcctgaacctgggaaatagaggttgcagtgagccaagatcgcaccaatgcactccagccttggagacagagtgatacagtgagtgggactccgtctcaaaaaaaaaaaaaaaaaaaaaaaaaaaaaaagaccaggcctggggcagttgtaaccagttatacttactaccttcccaataagcagtatgcagatgcttaagaaattaaggtttctgattgtgatgtgaagaataacaattccatgagccaacaaaggtctggaagtataaacagggtggaaaatggtctcaccagtgctctttcccttatcaaaagtatgcagtatcatactagacaatttcaataggatgccctggaaagcggtatttcctgatttcagatttaaaactgagaacatcagtaaatattttcttggaattaagagtcctctttgtggtactgagtgcatataatatattgaacagaactgattttcgtttgcttaacaaaaatggtcatgtgtttcctctcccccgtaacagttataaaagtaagaatgtaaaattcccttgggaaatgtttttaccggggctgactttcagaatctactcattacaactatcattgctattaaaaaaatagttcatcactatcattactaatgcgagtgatgtctaaaatttattgagcgcttactatgcgctagtgattgggctaagaggctaagtgactgtgtgaagtttacaactttttcctcatgtgatcatcatggccctgacaggtgggatggtattactgtccttgttttaaagatgaggaaactgaggctcagagaggtacttaacccctccccaaaatactcagttggtaactggcaatgctgggattttaccctggtctgtttcgtctagagcacagggtcttagctgtattcaagctgcctccaagggcaggcacccttcctaccagagtgcatcagggttggaaaaactaggagtcaaatgtttcttctcaaacagtgtgatcactttgaggtatcaaaatagtaaacatatttaattttagaaagatgctataggaatgaccacctgctaagagctaacgtggcacgtaatttcagaatttggccacttatccactcctctacattcatagttcagagttaaaccttaactcagcttgtcagtcttggggatagttacattattagaattttcattaaaaacatgcagaactaacaaaaaagatgaaacaagggcatacagacacataccgtgctctaatctttcatagtctgaatccaggagaaatgttttaaagcgattagacacatagtggaaagccaagaactttaagtaatagagattgaattcaaactcagttggatactggttgtgaacctgaaacacacaaggcaaagaaaagagtaagaatcaaacagaacaaaaagtggatgccaggccactgaaggcttaactgaaacatgcaggagaccattcagtcattcactcaacaaatacctgaatccctaccataagtagagatgggaagggaaccagcttttccgagcacctactgtgtgccagacaccagacgagggttttttttttttaaataaacataatctcatttaatctctacggtatagcaagagaggcattattatctccactttacaattgagaaagcataggatcagcaagattaagacatttacccaatgacattaaacagtagttagtgagcccaaatttaaccctggcttattaggctccaaagtctctaccccactcactacattatactgtgtttggcaattgatagatatatattaacataagttatggttcttgctttccaggcaactgtggtgtaatagtgtgacatacaacaagaaaaattgttcttacagaagtttggcaatgaaaaggattgagaagagaaggtggctgcttaaggggacagcaagagatgttttctggtcaaaagaaatgtgtgtgtgtctgaaggcaatccagaaggagccagtagagaaaacaaattttagaaaaatttgttagctaataactaagagaataagatcctgggaaagcaagaatgaatgaggctcgggcctagatttagggaacagctttggaaacagggagggatgaaaggtaagcaagagaaagatagttcaagtgccaagggaaagggcaggagctaatgccttttagccctaatttttcatcagtaaattaggcagtgaggtcattgggcacaggaataggaatgagtgaatgacatgggaggcagaaggctgggcaaagcttggaatggtcattgagctatagcatgctttaggcaaaccgtatacagactgtggagccatcttacattggcagagggtaggctgatgaccctgtgacactccctagtctgcctcgcaatctcacctctatattgctcaaacaatctctcatgaccagctagaaaattttgtttggctgaagtaagttccaatcataattgtacttgctcaaaagctggttcaaattaacactaaatttaggcaagctgtctaaaagtcagcgttctcctccatgtttaatttggcaatacggacctgtacttagtcagctgggtcagccaaagtgagcaggcatgtgtgtgataatgttgattgtccagtggaccaatgggaatttaaagtcgtgatctggatatcattgatttatcaaaatttatcatctggttaggaacctggttttctgtgatcattaaagggttttctacattttcttactggcttttgaattgaagtaaaattttagcttgtaagtaatgtaaaataaaatggattttaggaagatgcattaaaaaagagtttgactcctatgcagtgggcctgcaaaccacggaactgcttccttgatgtgagccaatgccttcctgttgcatcagatctccacaggacagcagagctttccatgggacatggctctgaatagctaggtagcgtgccatactccaggtttgtagaactgtaagcatttgtattacgtagagttttctcatcagtgaaaatgaagggataagaaatcatgggtttcctatgatcatgcaatacaagcaactaattataaaaactggctgggcgtggtggctcacgcctgtaatcccagcacctttgggggaccaaggtggaaggatctcgaggccaggagtttgagaccaacctgggcaacatagtgagaccttttctctacaaaaattaaaacaaacaattagccaggtgtggtggcacgtgcctgtagccccagctactcaggaggctgaggaggaggatcgcttgtgtccaggagttcgaagctgcagtggagccacaattgtgccactgtactccagcctgggtgacagagtgagaccctgtctctgaatgaatgaatgaatgaatgaataaatgataaaggctcaacttgaggagtttataattataataaaacaagcagatgtgacacataattaaggatcaatattaaaaaatcttttatttccttgttttgttagccctctatgtgtgtctcagtagtcaaccatgtcccttaatacagcaattctcattcaaacgcttgcctctactgatacttatgcacagcaaagaaggccctgggtttgactctctagtaggcctggttctctggtcttcctggctcctttcttaagcattgctcagacctcaagtttccccctcaacctgtcctgtaatgccatacagagctctccagtctgagctgttgctttggaatcaacagccccaccccaaggagccagtgatggagaggggggttactcagattgtggatgctgggacagaagaaggggacagggcaactaaggatggaacttggttccctaccatctgaatcctggggatgagaaatctgcagtgtgctcaggcagggtgagctccaaggacaactgccccaacagcccttgggataaaccttcagtagtcacaggccagcccctcactcactgtttccaagggaggaagagttctttccactgaaccagtctacaatatgttctaaaatttcttttaaaaatctttattaaagcctcaagggccaggcgtggtggctcacgcctgtaatcccaacactttgggaggccgaggcgggtggatcatgaggtcaggagattgagaccatcctggttaacatggtgaaaccctgtctctactaaaaatacaaaaacaaaattttagctgggcgtggtggcgggcgcctgtagtcccagctactcgggaggctgaggcaagagaatggcatgaaactgggaggcggagcttgcagtgagccgagatcgcgccaccgcactccagcctgggcaacagagcaagactccgtctcaaaaaaaaaaaaaaccaaaaaacaaacaaacaaaaaactgtattaaagcctcaaaataacatttctctcaatgactattcttcatagaaaccagatacctcatacatacttgtatcttttcttgatgattctgacatttaatctactcaggaatacaattttgaagacccacttctgaggtaacagtagaatggaaatatgatcttaagttgaacttacaggcatttcagggagatcatgtgctcagattaaaagtgaaacgtctttacaagtcaaaaaatgctttcgtagcccagtatattggcctcaccacaagccctctacagttatgctagaaaggttagacaattttccaaggcctcttgtacccactccactgggactggaattggtgcttggagaaagcatcaaggtgtatacgcttgggggcactatgcatgtgtcctcctgtgtgccacaggagcacctgcagtcgctaactggggttgaaaaacaaacctcccccaaactggggttaacgatcaggtctactggaagtggaagagaagatgcagagcaatttgttttttactcttcagcaataaagtaacaagcatgtaaacatttctttggtggaaaaagaaaagtcagatagacctcaagcctgggttgattagtacctagataccacgtttagaatccgacattaagaaacataaggaattttctgagatgtctttcttccatcatgtaagaagaaatgatgagatggctgaactcttacggtgcttagatttctaggaagcaagaaaaatcatactttctccattgagtcctgcaccccagtgactcagtttgtccagttcactggcttcttttcctctttgcaaatggaactcacctagactcttgtgattttaatttgcattttctaatgaagaatgatgtcaacttttcatgtgcttatttgcatatctttggtgaaatcagtacaaatgttttgcccatttcaaaaataagctgttggccgggcatagtggctcatgcctataattccagcactttgagaggctgagatgggtggatcacttgaggtcaggaatttgtgaccagcctggccaatatggtgaaacaccatttctgctaaaaatacaaaaattagctgggcgtggttgtgcacacttgtaatctgagctattagggaggctgaggcgaaaggattgcttgaacctgggaggcagggttgcagtgagccaagattttgccactgcactccagcctcagggaaggagcaagattccatcctaaaggaaaaaaaaaaggttgttttcttattattgaattttaaggtttctttatgtgttctagataaatccttcagcaaatatatggtttacacatattttctcccactgtgtgattggtcttttcatttgcttaacagggatttttaaaaagtatttatttatttatttaaattattattatttttttgagatggagtctcgctctgttgcccaggctggagtgcagtggcgcagtctcggctcactgcaagctccacctcccgggttcatgccattctcctgcctcagcctcccgagtagctgggactacaggcgcctgccaccacgcccagctaatttttttgtatttttagtagagaaggggtttcactgtgttagccaggatggtctctatctcctgacctcgtgatctgcctgtctcggcttcccaaagtgctgggattacaggcgtgagccaccgtgcctggccaaaaaaagtatttattatgttttttagaggtggggtcttgctgtgttgcccaggctggtcttgaactcctgggctcaagtgaacccaccttggcctcccaaaatgctgggattataggcttcagccaccatacccaggatcagccttgtaatatttgtagaatctgtagtgacgtcatctttctcatttcttatattggtaatatgtgtcttttttttctcaagcagtctagctagaggtttatcaattttattgatattctcaaagaacagcttttggtttcattagttttctttattgttggccacaagattttggggacctaaaggcaagtgtgcttcaaataaatttagccttattatattatgtagaattgggaatgataggtatttcagctaataaattaattctatgtcagcatttccctaagtatggtgatgaatagagttttaggcttctctcaggtatcatctggattttgttgttcaaaataattttgtatttattttgttgcaggttaaaaagtatacagacttaaaagactaaactgcatgaagcattttagttttgtttttccgttatggagtgaaacttgccaacttcacttatttataagaagagaatctgaaatggaatttggagaaacatgaatttatagggtctttttttttgcccatgtgccattaagtactttgtaaaatttaaaggcctataaaaataagctatgactcaaacccctggaaagatcaacattttggaagtaaagtttaatacattaaaactggattctgctttcagaattataaatattgagctacaagagacactatacatcaacacgtgaaaacctggatatggttaaacagaccctaggagagtgtatagctaatattaatttttgttatttcacaaattaagatttaacaaacattgtgtgctttgtgttacatccttccatattacatggccttaaatattaagctttgatgcaaaattgccttgttataaaacagattggattatgttcatttttgccagtttgcagttgaataggcagcagacagcagaaactcttgaatataccaacaatccattagctacagctattttgccaatattactggataaattttagaataaccaacctgtgtgggggcagcttagctgctcacatatgtgctcacaaggaaggctcatatcttcaaaaggcaaatagcttttttctttggggtaggacctagcatagtgctgtcataaggtaaccatgaggagaatcacataaagccagaccaaagtgaatcaatttacaatttgaataaactttgaaatcacagtaaaaaatactgaaaaagttctaagatgccctcaaagatttactctaatgccgaaataaaggggatgctttcttcacgttttcattcatactattcatgttttctcctgatattatattttaaaaagaaagtttacataaaaatttaatctttgtatattggattttttttaatttggctcaactattttaagaaaagggagtcctgtaatgatatcatttgagctaagccaatttcttttagaagcaaaaaatctgccagatgttgctattatgaaacagtgagctagcatttataattcatttgacacctggatatactggcgtaaacaatggctttttatatgatgaggcagttctaatttaagttcagtgcttcatctgttttcttgtaactttattagtactaatggacaagcctaggcatatgtccatggactgccttttggcattcaatgttagaaatggttaataagcagggaacacattccatctgggaaagcttcacttgctgctgtgtaattttgaacctgtttttttgatgtttctgggcctagttctgttgtgtgtccctgagagactgagggcagcactaattcgaattatctggtaaaagccagagtcatgtaaagcactagtgttcacttgaaaggcattcaaagaaggcattttctaatgcctaaaaccagtatgtcgaagatgatgaaacactaccttataattaagtcagcaagagtcagaaaaactatttgctaactatagtcttcttagattcctctgtttttgagtgaataaacaatcccttttcagcacaaaataatttgcatcaccaaagctgatacctctggtagccaagcatgctttacttactgcaattaaggtcatatgcttgctttgctatgacttgtctgcacttaggttattatgtatgaggtattaagtgaaaggaggattcaggcaaattcttaaaaatttatgttttaatttaaaaaattttaatttggcacagccagatttgaagtcatactgatagggtctctagatcctgaacaatattactttttacagtttgtgaagcattcacctacaaataatcgaactttaattaaaagttaacttctgtttttgatttcagaatcaactggtttatataaaacatttgaattttaactctttacttgaaaaaaaaaacagatgaatcttaaattcagctgattagtaaataaaacaaaacagcagaaattaagcatataccccaaattgttttaattaacttagccttttgtagttttagcatctattgtattctaaagataataggaatgtaagttatgctacatcttagtgtatgttaaattgctttaatcataccacttaaggggtactcacagaatacaggttaccttccagcatctagacctctcccactcctcccccccagccccatccccaataataaaatagaagaatttcattccaagtaaggattattgtacttgggagacaatgatgttcccatctttgaggacagtgtatcttacatgagaacctcctatctcttactgattgtgagtggattatttcgctgaccctaatgtttaggtgtgcagaattctgcaagttgaacatagagatttaacatattaagtagtccatttaacttaagccagatttggctgtacaagctcattcccctggaatcctcccacattaaaggaatttttaagaggtaaaaaacccaaaagggagtggggagaatgggaggaaacacagcactgggccaaagcaattcagcaaatttttgaaagatggaaaatagaaggaagaatagcagtaaatgatagaagaggagaagctatactgggattcctgccaggaggaaaatgatttgagaaggtaacgatttgctgtgtaaacccagaaaggctcagggcacagaggcccaagtattgagtaatgcaggggtgaaatggaggctatcgtgggactagctggaagtctatggaggcaggaaaggaccccaggtcctttcccaccccatgtagtcatatgattacccttttcagagcaacagatcggaggtttattttctgaaaaacaaacaaacaaaaaaacaaacctgataagctctagacttgggaacaccagacacaactgggttagtggaaacactgaaaatagcatggaaaaaacgaaaagcctgcattactgaactgggatttccctggacctatttcctgccctgtttccataaagcaagcagccagacctacaagtactttctgggccccagacaaattcttctccgtagaaacaaggtagctgctgttttctttctctggaactctagtttactgagatgttggacttactaattaaagattattattttttcctccagatttattgaagtgttatttaaaaataaaatttccctactttaagtgtatagttttattagttttggtcactgtacacagttgtgtaaccatcaccacaatcatgatacagaacagtttcctgacgctgaaaagtttgcttatgccctttgcatgatgattgatcccctcccttggtcactggtcccaggcagtcactgatctgctttcagtcactatggttttgccctttttagaatgtcatataaataaacttatgtagtagtcttttctgcctggcttctttcactgaacatagtgatcacaagattggtcagtctttgtaatataaatatttcattccctttgtgtgctgagtggtattccactgaattaatatgccagaatttgttcatctcttcatcggttgatggacatttggtttgtttttcatgctacccctttatagtcacactcatttccttctcccccactatcttgaatctggcaaccaataatttatgatcttgtcattttaaaatattagctgggcatggtggctcacgcctgtaatcccagtactttggaaggccaaggcagatagatcacctgagctcaggagttcaagactagcctggacaacatggcaaaaccctgtctctaccaaaaatacaaaaaattaaccagctgtggtggtgtgcacctatggtcccagctacttgggaggccaaggtgggaagactgcgtgagcctgggaggcggaggttgtagtgagccgagatcacaccactacactccaacctaggtgacagagtgagactctgtctcaaaaaaaaaaaaaaattatatacatggaatcatactcagttggaccctttgagattgccttttttttctttcaatataatgtccttgagatcccttcaaggtgttgcatgtgccagtaattcctttttactgttgagtagtcgtccacggtatggatgtatcccagattgtgtagccattcacctactgtaggacagacatttgggttccccccagttatattcaaatcggatatgtggaagggtaattctttaggaaatgtggagccactgaaggtttttgtttgtttgctttgaagacttttgtggaggggaataaaaggattgtatctgagcttttggaagattatgccagcaattctacttaggatattctagattttttttttttcccccaagacggagcctcgctctgtctcccaggctgcagtgcagtgggggcttctcagctcaatgcaacctccgcctcccgggttcaagcgattctcctgcttcagcctcccaagtagctgggactacaggcgtgcgcccccacgtctggctgattttttgtatttttagtagagatggggtttcaccatgttggccaggatggttttgatctcttacctcgtgatccacccaccttggcctcccaaagtgctgggattacaggcgtgagccaccacgcccgaccaggatattctagatggtcttgatgaagggtggtaagagcatgaacaagacttgtggtctttcaaattctcatatattcattgagattatctatttattgtctattatattccagagactgaaactgtaattgtgttagatactagggatatgaagactagtatgacatagtccctgttcccaagaattctcagactaagtagagggcaatagttacatacaaataaacatactttagtgctatagatgttatcaaagaagtctatacctgactcattagaaatacatataaagtgggagcgtgagggtcagcaaaagattcaaagaattatgaactaaaataacatgtgtagtgctcagaacagtgcctggcacatagtaagcagtcgacacaaattagtaattattgttagtaatggtggtatacggaggcaggaaatagtctagtccaattgataagcataataaaaaagcaagataagaagtgctttcatgaagaactcatatgctttcacctgcctagaagtgagaagagatagatgcttgctcctctcctttggcctcaggtaagctttctgtttcagagacaatggtctccaaacttctccctcatctatttgccaaaaggagtatgaataaaagggccaatattcaaacagaaaacaaatatagtatactctttgctgcaaagagtttaaaggtacatgcttaaccttgtgaccagctcctccagttactgcttggacagatcaattgaaattcgtcaatcggtcttgtctttaataagtaaattagagcagtaaaaaacatagcttcctgtgtgtggggtgaaaggttggaaagtcactgctcatgagtatggagtttctttttggagtgataaaatgctctaaaattgattgtggtaattgttacaaaactttgtgaatggattcaaaaccactgaacactttaaataggtgaattgtatgatatatatagttcaataaagctgttatttacaaaaattatgtagtgatctggaaagttgatcaagtgattactagaataaaaacaaaataaaacataaccacatactaacttggtgtcatcacagttagtttcaactctggttcctgaaaacatagttctgcctttctttccaatcgatatttgaggccagtgtgtttcaaagaggctcaccattcccacaaatgtttgacatgccagaacccattcatccaaccctgggattgtggtcaaatgaaagctggaaataggcctgcttttcctaggccaattcagtcttcaacttgcaagctcagtgccatccaattctcaaacccaatcctgaccaaggccccatccagaggtctgtatctgatgtgcctgcgatgaaggcaggagggagcctagagcagtcacatctcccctaccctcactgcatttgaatggatatacctgggctcccacttataagtgagaacatgaggtatttggttttctgcttctgcatcaatttgcttaggataatggcctccagctatatccatgtcattgcaaaagacatgatttcattcttttgtatggctgcatagtattccatggtatatatgtaccacagtttctccatgtggtagaagtgaccagtgttctcaagcctgtatgcctgtctggctgggccctgattatttctccaggggttaggctttacctcttatgttcccaggcacaagctggggtcctcccaaactgggcagaccatgtgctcgatttcaggacccgtattacctagagattttgttcttaggtaataagcccaagtttgcttctcttctttgaagatggtcatttagagtgctggctacttcacttggggcaagcccaacagccagcttagctgtcctagtttcagaaaccaactaattttttttcttttccattcctaggagtctactgctaagatttcagcatgtcctgtggctgagttaatcagagttatgacaggaaggtaccgggcacaccatcgcaatgctccatcaatgctagtatgttgtgttctttccttcatatcaagtcaactcaagcttgctctacttacctggtgtacacagtctaagaactgtaagaagactggagcaaaaccactcccctgacagttgagggtcaagctgctcctctgactgaatttgtgaccaaaagagagccactctttttcaaccaacatctggaagccttcaagtgtcctataaaagggatcactgagtaactgaaccagggatgtcacctagggcataagcaggatggattgtcattaattttagttctgaaaaaggcctattactaagataaaagcacttccttctgatgatagctaattcacaaatttacctggacagcaaatttgttcactaaccattccaggatggccaataaaattaattttgtaaacttgccagtaaaaactaaagctcaaattcattttggctacaagtttactttcagggaattgagactttaatccttaactggccagtttgctgacagcaaccttttcctaagttaatcagaggccagaggatcagttaaaatcaattctactttttggcagatgcagattaatgtcttaatgtagtctgaactcacacttttcactctggagtgagttaaggcggggcttatagagagccaggggatggactgacaaaacccaggaaggatggtccacgcctcacactgctggtcaagggctccatccgcaagcctgcatggtacatctgtggatgggagagcttgatgcccggagccagagctccaggctgcgtaggggctaagagctcatggtacggagttttctgatggataccaggtgctgtttaacacaggactttctctgtccataaacacattagtcattatacaaaagagtcatctgaagaatttaaaaatgaccaaatggaaatataaatataaaatatcaaaaaatatgtctaatagtttacttgtgcagtgatgtcccagccttcctccaaacagaccaaaactgaggaaccattctcaagtacttctgatacaaccacagccagctgcattatcctgtgaagctaagagacaggaaggagaacacaattagaccaagcgctttctgagtgcagaagtcagagagagttgctttcaaccctggataatcaaacgacttagggataaagcgcttgcacaaaagaaccacataatgttttaaatacctaaagttctttcaaatcaagattaaacaatgacacttttgactggatgcaatgactcatgcccataatcccagcactttgggaggccgagccgggcaggtcatttgaggttcggagttcgagaccagcctgggcaacatagtaagaccccatctcaatgaaaacaacaacaaaatgacacttcaaaaaagtagacacattttaaaacaatacattctagtaatacataatgaaataaaattaccttacatgattcccccaaaagtaggtgagctataattccatagagtacaaaaaacagagattctatgtggacttcccaacaaaagacggaaattcagatgaattttattggatttaaaatttgtttttccatgatgtagtaagttttgtttcagacattttttttttttttttttgagacaaagtctcgctctgtcacccaggctggagtgcagtgatgcaatcctggctaaccacaacctctgccccccgggttcaagcgattctcctgcctcagcctcccgagtagcttggattacaggtgcataccagtgcacccggctaattttttgtatttttagtagagacgaggtttcaccatgttggccaggctagtcttgaactcctgacctcaggtaatccacctgcctcagcctcccaaagtgctagcattacaggcgtgaaccaccacgcctggcctatttcaggtattcttaattttttgggaattagatagtggtgatagttacacaatgttgtggacataccaaaaagcgttgagttgtgcacctttatcataaggataaattttatggtaagtgaattatatgttaaaaaagaaactcctggctgggtgtggtggctcaacgcctgtaatcccagcactttgggaggttgaagcaggagtagtgcttgagctcaggagtttgagaccacctgggcaacatggcaaaaccccatctctacaaaacatacaaaaaccagccaggcgtggtggcatctgcctgtaatcccagctactcaggaggctgaggtaggaggatcgcttgaacctgggagatcgaggctgcagtgagctgtgattgtgccactgcactctagcctgggtgacagagcaagaccctgtctcgaaaaataaaaataaaaaagatactcctatttgtctatactgtgtactaaatgagaaaaaaactttcaatatatttgtgctaagtttttaaagccacatcaattggctcaaagtccttaataaacaattaaggtatgagaatagtatatagattttaaaaccagatgtataacattgtaattttaaaaaatattttaatgatcatcagacataatttgcaatttgaatccaactctgaacaagaacaaaaatgaaaaaacccatctcttaaacagagctaggctactttaaacacaggaataaggcaaatgccctactcagtaatgagaagctcctcatgtaactgtttctacaacatagctatcaccaggcctgaattcttttgggctcagaatttgttctaagaaatggctattattaaaaagtcaaaaaataacagatgctggcgagcctgtggagaaaagggaatgtatatacatttctggtgggaatgtaaattagttcagccattgtagaaagtagtttggtgatttctcaaataacttaaaacagaattaccatttgacctagcaatcccattactgagtatatacccaaaggaatataaattgttctaccataaagtcacatgcacacacatgttcagtgctgtactattcacaatagcaaagacatggagtcaacctatatgcccatcaacggtagactggataaagaaaatatggtacatatacaccatggaatactacacagccataaaaagaatgagcttatgtcctttgcagtaacacagctgaagcaaactaacacaggaatggaaaaccaaatactgcatattctcacttataagtgggagctaaacattgagtacacatggacacaaagaaaggaatagacgcctggggcgtatttgaggttggaggtgagaggagggtgaggatagaaaaactacctatcaggtactatgcttattacctgggtgatgaaataatctgtacaccaaactcccaagatatgcaatgtacctatacaacaaacctacatatgtacccctgaacacaaaataaaagttaaaaaaagaatttgctttaagagttaacttttaagatgtcaatatcccaagtgggcaattattttccactgtctttagtccctatcttttggtacaggtccactttctagcaaagagtagagcacagaatgtatcagaaacatggatagataagttgggtggaggggtccgtttggagctggggctcatagcctggggacagaagggagtatcgaccagttccttccacgggtatgcaaagcaccctaaattgccttaataataatgaacacagcatgatacatttatagccaaatatttatgtggcggcatttctctttggtttaagtatcttgagaacagtcacagccctgagtactgacatcatttcctttttttttttttgccttttagtccaatgtgctgtgggaaacaagaggcaggatgcttggaggtagatggaggcaggggactgggaatttctgcaaggtgataacaaataatgggggccaggcgtggcagctcatgcctgtaatcacagctctttgggaggtcaaggtgggaggattacttgaggccaggagttcaagaccagcctgggcaatataagaaataaaggggcttaaagacaaggccctttaatttctcaataaaagttcaattaagaatatcccaaagttgactgaactgaaagatgatagacactgtgtttttttttcaagccttaggtaggcttgggggcatccagtgtgcctttggtgggtagtgtggggtggatctaaaatctagagacctgggataggcagacaaatgaaaggtgagagctcttgggagtcatgcagaagttgccctctgccctggatccttactgtattgacaacagagcaggagccctgtaaatacatgctgattaaatttacatcaaagatttccatctaaaaataattttctccttagtgtcctatagataccaaacttttaaatacacagagataaaaacccagcgatcaagacttctactccctcacctcctataccagatgatttccttagtctgaaaggcctttactgatggcacacaatgaaggaggagaatgttggggagtaggggaacaaagtattttttttctcaaatacagttctgtatatctacttgggcctctgtttctttgagttataaagaaagaagctgcttcagacattacctgtgggaaccactcagaatctcccagcgctttcaggaaggtcacttctgagtcagtagggatggtgcttgggatacaagccctcatcagcttcttaaaactggctttcacttgccggatttcatgaaattcaacaggaacaaactcacaatttaaagcaaattctaccttgaagttctgcggatgaagattcagagaattaggcagatgaagtgctataggtaaaagagtgatgtttccaatggggcagtgcataatgacaaagttatttggggccaaatagctgcagaggctgccaatgggtcaagaaagtcaatcttgtacagcaatgtgtcagtgttggtgggaacagccattcagtacaagctagtggtttgcccagaatggcaaatctagtccttactagaggtagattacttagcctaagaatgcgttcattctgagaactggaagagcctactggtagactggaacttgatggagctcataataccaaatataagtcaattataaggccatgaacctggaagtttaaagagaaactaatgatacatggacagtatgattactccaacagtgtaaactaagtcttcccaagatgtatatggtaagggataggtaacacactgttggagttccagactgtacgtgtattaaagtttgtagatatgcacatatttgtttcttattatgcaagtaaaacatattcataataaaaatgaaaaaaggtagagataaatattgagaaagaaatagaaatcactttcttactgccccaagactaccaacattgtggttatttttttgtttttttgggatggagtcttgctctgtcacccaggctggagcgcaatggtgcgatcttgactgactgcaacctccgcttcccaggttcaagcgattctcctgcctcagcctcccgagtagctgggactacagtcgtgcgccaccatacccagttaatttttgcatttttagtagagatgggctttcaccatgttgcccaggatggtctcaatcttttgaccttgtgatccgcccacctcggcctcccaaagtgctgagattacaggcgtgagccaccacgcccagtcctacttcttaaaagtcaataataaaaaattacatggtcgggcacggtggctcatgactgtaatctcagcagtctggaaggctgaggcagacagattacctgaggtcaggagttcaagaccagcctggccaacacggtgaaatcccatctctactaaaaatacaaaaagtagccaggcgtggtgacaggcacctgtaatcgcagctactcgggaggctgaggcaggagaatcacttgaaccccggagatggaggttgcagtgagctgagatgacaccactgcactccagcgtgggcagcagagtgagactccaccttaaaaaaaaaaattacataaaaaaaccacgaaaggctttgttcatttctatctttgggataatattttttcacttaatatatgtatcaacctatatttatttgagtactttctcatttacatctttaatccttatggaatttattttgtgtgtggtatgagtgttgcatttgcaattaaagaatgctatactgatggcctactggtatatttcattttaataacctggttgcctagctctgaagaagatttaaaagtcctctaacttttcatgccaaagaatgaattaattttctcaaaatgtttccactttcttttcattgtgcccaaattactctattggaccatctgcttttctaagattaaaactgctttctggagattggttgcacagcaacataaatgtacttaataatactgagtcatacacttagaaatggttaagatggtaaatcttgttatgtgtattttataatttttcctttgtcttaataattctatttttaaggaagctattctaaggaaataatctaataggaaaaaacccccagggaatggtatctcaattaaaaaaaataacaaaataacttatttgcttggaattgtgactgtaattttatatacagaagataaagaaacctaaacatccaacaacatgggatgaatagtgactaaaatagttatgaagactatatgacatggaaacataatgttaaggcttcagataaataacctagcgatatacatgagttcctttctattatttttaaaaacttataatagacaaaacatagtttacttttcaggaaaggtagattcctatttcccaactatacatgagctaggtatgcttatcttataaaccaggagttactaaccaaagtattgagacactccattaggttgtaaggaatttgttcctaataataaagtattaaagtatgtgaatttacctaggtaaaggccaaattcaagattattttcagaataagtcactgtaatttattggctttcatgtttctttgttgggagaaaaaggtatggaattgtaactggatggcattgtgcaagctagaatgtggcacatatcagacagatacagagccatattctacatacaaaattgaataaaagataaaacctgaatggaatatatagaatagctgacaactattgtgccagaatggtgggattacatttttaaaaataataatacttgtccgggtgtagtggctcacgcctgtaatcccagcactttgggaggccagggcgggtggatcacaaggtcaagagatggagaccatcatggccaacgtggtgaaaccccatctctactaaaactaaaaaaaaaaaaaaaaaaaaaaaaaaaagctgggcgtggtgacgcgtgcctgtaatctcagctactcaggagactggggcagaattgcttgaacctgggaggtggaggttgcagtgagccgagatcatgctactgcattccagcctagcgacagagtgagactccatctcaaaaacttaaaaaaaatataataataatattttattgaggaagggcagacagaaagaaaaagagggcaggaggaagagagggaaggaaaaaggcagcatcccaactctttcttactcaaatacgtatgatcacatagctaatctgagaaattatgtgcaaagagaatggcagaggggagtattaaggagctaaacctcggagagtgattcggatcacgagtaagtgttgtgctgaagcatggaaagtctgtgctctggaaaagacactggcaccagcaaccctggattgctgtagaaaagggttctattttttggatataaaattatctactgtatcagaagacacatatgcagatttaaaacttgagcattacccagcagttttatgccctctaccctaaaggttagtgactaagtggttgcagcagtccaggcagtgggagaagagctagcaaagccactagcctgctccagaagagatgactcagttactggcatcttaagggccaagcatgtgggatcttgctaatggcaccctgctcacagtttctgctccacggttcagccagaggtctgtctaggttgtccagtgccaactggagcactggattaaacgttgagatttctgagttaacagataactttcatgtcctatatacctactggtagtaatgaaatttattttgtaatgtgtgacttgcaaaacattaaattcaaggaattgttgttgcttttggaggaaaagaccatctttacaatttatgggccctcagcatggtgaagctctttagcgcaacaatttaacagtaagaataaagttgattagcatctagtattttgaattttctgacacatcttaggacatgtgtctctttctatatagctttgcgaagttttaacaagtgttactcagaaaacctagacttggccttgccttgcctccatacatggtaccacagtcttcctctctccattcttctatgtttctgtagcctgctttaggtttaccataacaaaactatctgttttgccatgggcagattcctgtggaaactgaatcaaggctgttgaaaacacagcctgatgaagccttattccttttttttgtatgtatgtacgcttcctgatgtttatgttgattttttactattatgaataaatatttattttcatggctaataaatatgcatatgtatatacatgtattgatataaaaattaatatatataaataaatacaaaaggagagctaaattttttgagattattaactccaggttaagaatcatgctgtaaaaaaaattctagcaaagctggtttgtgatacaggttttatcaacagccctagcgtatccataaagtttctaagtgagaaaaaagaaatcttacccttagttgcgacttttcaccaaatatgtaaagggctgcttgccgtttcaagagctggttttgtaggtagctgctgttactgaaggaggccgagtgatccttgcctgccagccgggcgccaacatcaatgaaggatgttggagagctgatcaagcgagtgctagagcgaagacttgcccacacaccttcacaaaagccaaagtcgtggagtgagataatctaatgtgggaatgccactaactaaggaaaaaggtgcatgctctggagctacagttttagaggtcatagcaagctgattaatctaaaaaccgtaagtcatatggtcatttgctacttctgtaacataaacattatccaatatagcatttcaaaatcacacaatcttagcctcagaatgacctagcaaatcccccaaatcaatcctattttatattttgatgtaaattcaggatttaaaagtaaatactaagatcttaagcagaaacagtacattgatactgaaaacaaaacatgctggcaggaggtactaataaagtctaggaaggcaaatgctgagttatgcaatttctcagggcttcatgaaaaaagtaaggaacattcttctgcttatttggtcaatttaacatgacatttaaagatatgaaatagaaacttcataagtctactaaaatctgaagctggatttggaattaatatttgtatatcatgccaaaacgatgtaattctaaacaagattatattatatttttcagtatccatgaagaatgagaattataagtttagtaatgggcacagtgcctcatgcctgtaatactagcactttgggaggccaaggtgggcagatcgcttgagcccaggagtttgaaaccagcctgggcaacatggtgaaaccccgtctctaccaaaaaaaaaaaaaaaaaaaaaaaaactacaaaaagacacctgtattgggaggctgaaatgggaggatcacttgaccgctggaggtggaggttgcagtgagccaagatagcgccactgcgctacatactgggcaacagagtaagacactgtctctaaaataaaataaaataaatgaataaaatgtacagtcagaagcctatatctttattttattttttttgagacagagtttcgctcttgttgcctaggctggtgtgcaatggcgtgatctcagcacatcacaacctccacctcctgggttcaagcgattctcctgcctcagcctcctgagtagctgggattacaggcatgcaccaccatgcctggctaattttgtatttttagtagagacggggtttcttcatgttgatcaggctggtctcgaactcccgacctcaggtgatctgcctgcctcagcctcccaaagtgctgggattacaggcatgagccaccacgcccagccagaagcagataccttctaagagaaagggcaagctaaaatgctagcagagtctcaatgagataagatgaccttagttatattaattagaaaaatcaaggatttctatatgcaagtgagactattaaatatcaaacatccagacacaaaggcatgtactaattctcaaatttgactagcactgtatcaccttcaaatcaagaggccctcataaatgcctgtagaactgtggtgtttatctcattgatggggtcacagggatacaggactttcctactgcctccctcaagtgggttttcttctttagatctagaaagcctgtttgagaagctttagtcttttcctagtattaaagtcatgtttctaggtgaccagaagtcaccatgatgtcacatctgcttctctttctctttataagcatttacggggtcaggagaccagttcccaagaaaagtttttattggtcatttcagcttcacatgcacgaatctttctttgagatggagtttcactcttgttgcccaggctggagtgcaatggcgtgatctcggctcaccacagcctctgcctcctgggttcaagtgattctcctgccttagcctcccgagtagctgggattacaggtgcacaccaccacgcccggctaatttttgtatttttagtagagatggggtttcaccatcttggtcaggctggtcttgaactcccgacctcaggtgatccgcccgcctcagcctcccaaagtgctgggattacaggtgcgagccaccacacccggctgcatgaatctttctacgtagtttacgaggttttcttagacattatggcaattattaatttttttgtaaatggaatcagaggaaattcagaatgcagatgagaataaaggatataattttacaaatgcaaaaaaattacttgtaacatatgtagtttcacatgaagatggtttaaaagagtgatatatcaggacacataatacagtaccttgattatggactcttcccttagctgaagatttgggatttgactgagtaaaacatttatctctgtacccatgcactggtaggtaagattaaagacagaaagagaaataaaatgtatatagcagcaaatgtcagagcagattgagtaagagaagaataggctatttaatttttaaaattagcaggggaaaaatgtaaatataataaaagtagaagatttaattaacaaacaaaaagctgcacagtcacaaaaaaaagatgtattgagtacctgttaaatgaaatttcagcacctgtttataaatactataagcacaatgaaatggacagcacacagcagaaggtgccactaaaaaattataccaaatggaagaagcttttgaagattgtcattcagtcagaaacaaatttttataataaaattaaggaatttggggtgtgtatgggtgaatgttaggaatacattggtcctcatattgaaggagaatggcgaatgctgcatgttgtacaacacgtttgttctttgagcaaggtcatcacaccaggaaacaatgaagctctagcaaccatttggaataactaagggcatgtttttgcagtagagcattaagcattgccacgctatcttccttcttctcttttcatttggaaattatatttattttccataattagttacgagcagcaaaaattcataatcctgtgacaatacccaatatcactaataatacagcttgtgatgactgaagtaatgacttctcttaaaatccctacttgcaccaaaatgacaggcagtattagagataatagttttgtaatttgagtaatatatttttttccaacagaaaggggtttatgatgatggcaaaccaaaaattgtgagcagttttagcactttccaagcaaacaaattgctcaagtcaattagaagaaatgattttatatttattcaggattacaatctttaatagtagtattaagttataaaatgcaaaagtgtataacatatgacataacaaaaatcattacaagtgagttttcactcccacttcactcctttggaagcagaaaatgaagggcactgatggctctggtggccaaaggaagccagaaagtaagggctgcagaggtgctggctgatgacagacagagaatgtgactgcaagatggaacgaaggcttgggacatggccaaggcacactgtgtggcctcctctgtgttggctgactgctctcctttctgccaaaattttgaactttcctattgaatatgggacactaagatgatgacagtgatgcttgagtagttcctgattctgagatactgttcccttaacacatcacactttcttatgctagtcttactgcctggaatgatttcccccatttccttacctgacacattcctacttaacccttaagatccagatacaatattagcacctcttaaaggcattcctgactgctcccaagctgaggagctctatttgaactttgatcacattgtgtcgattatctgtatattctttcactctacaagattgtgtgtgtgaaaggaaaataaaaactcaggactccagttcactacgtcaaaaggaaaaaattaggctgaaaggtgagacataacaagacgctgcttttccttttgttcctaaacaaacagctacagttaaaaggttaaacttatccacaggtagctactggtatgttcactttaccttacagatgaatacataattgactattcccctacctgctccttttttcttgcaacatgtggattactataccctccctctttctcgtttaaatattaaagccctcaaaatcattgttggagaaaggcacagacctttctccagggcgagtccttaaccttggcaaaataaacttctgaatttattgagacctgtctcaggtactttttggtttacatgtgcttgtgagggcaggcacctaatcatgtttattctcgtatccatgctgagagcctgaaatacaggcactcaaagaatttgttgattatttactttttgcaaaccaatacattgtgagctgttctgactcattattgtatcttcaacccaattatttgcactgaaagagtgaaaagggggtattaaacaaaaaatattaaggactcccccaaacagaggctcatcaatgaaaaactgccaagttttggccaattagtagaaaatccgcaatgataaaatggccagtactgatatggggccagcagggagctttgagaattctaatcccatctggaagtcattttaaccaaaggaattagactaccgcattggttgttggtggtgaggtctacttagatttcctgaatgatttctagatgtcctgggcacttaacaccagcaaaacgtctcaagctgtgtttttccaagctgcaggatcctccttagtggcttgggaaatcactctaataggtcaaatcagtatttttttcaaaattaaacattacagttgaaaatactaatgagcactgcatgtggtacggatgaatattgtttcacagaacttttgttttagtgtatacattatacattttgcatgtgccttagtactacctgaattgtgatataaaatgaatgggtatatatacatataaatataaaatacatttcttactgcgagtcatgatcaaacaagtttgaaagtcactggctaaacctagggcatatgccttctatctcttgccttagatcagtaaggctcaaagcaatttaaatgcaaatgtcgactttcttcccatttcagcagagtattaggcaatggcaatgataacaataactataataataatgacaactaacatctattaaaatgctactatgggctagttactaagttaaatgttttacatatactatttaatttattcctcataactaccttaaaagtctatattattttttaaagatgaagacactgagaattaagaggtttcctaatttgcttaatcacacagtaagtagtgggactatggtttgaattagaatgtaactaaactcttttttttttttttttttttgagacggagtctcgctctgtcacccaggctggagtgcagtggcgcgatcctggctcactgcaagctccgcctcccgggttcaagccattctcctgcctcagcctcccgcatagctgggactacaggcgcccgccaccacgcccggctaattttttgtatttttagtagagacagggtttcactgtgttagccaggatggtctcgatctcctgaccacgtgatccgcccgcctcggcctcccaaagtgctgggattacaggcgtgagccaccgcacccggccactaaactcttaatgtattgtttcctgaggaaccatgtgaccttggacccaatcagtaagaaccggctaaggggactgcttcagggaagatatgacacagttcattttccccataggaatgcgttactgttcagagaactagtgtttcctaagcactggtgttatttcctctactctgttctgacgaaaggggagagggaaaagagatgcttaggtcacatgtggggccttattgatcactgtgatcttatacctggcccagtgcatgagacactagatgtattcagtaaatatatctgcactgatacgatgcaacactgaactaattctagtcccagttatactaatatttgctatgcagccttggccaagtcacttaatctccctgggcctctttaaatacatatcctggaggttatttcaagaataaaataatacatggagaaaaacttaaaatgtaaaggatgaaaaattaaaaagctgcctccaagtggctacttctcaaatatacccagctattatattttggtatttgagaggcagtactaattttctcaaggcatttttctactcaacaaagaaatttatccaagttgtaagtatatgtgtttccccattgggcttaaatgctactttaattttaaatgaaaaacaatgtgatctattcacttcttgcttttaaaatgattcttaggtaaaaaaggatgcagcccttgtattaggaactcaccaacatgcatgctgaatgcaaagtgatcaccctgactgaaaaagaggtgaaggtcaattttaaccctggctcatcagaccaggagagacacacagtggaaataacataagaaaacttggaactaagactgtacgacaatgaaaagaatgaaaaaaattgtgaaaataggggagcaaaaagaaaaaggctaggaagaagaactaggggttagggtaaaaaaaaaaaaaaagaagaagaagaattaaatgataggaggctcctctcacagtggtatctaactctggaagaatgaagagactctgtactgtgagtcggtacaaggaaatgaattacttgcaaggcatgggcatgtttatacctagtcttgccctggccagtctaaatgtgtgtctgcctggtatgttcacataacagagaatcttttgagacccttaacttgcttgcctcagttcattcgtcctactttgagaaggaatgacactatcagaagaaacacagaaagcagctctagagatcacagagaatgttgaaggtgtcaggaaacagcagtatctctttgtccagtttatcactgggacttcacaaggttttggaggctttaggagtgaagagttaagagatggagtaaaagaatgagatttgcgtttctggattttagcttaagataccataatgacaagcacctggttaggagtaaaaaactgtcataaggaaacaagccaaattcacagtaattttcagcagaaagtatttgagaagggtgtcagaaataatatttatagcctcagatatgcacatagtggtcataagttaaataggagattttaatctgaaaaggtaaatacagccttctgggtgcctttaggattagcaaagaatggagtcataagaatataaccactactgggaattcccttgtataaaagaagccaagagttggaggccagtgttaaaaaagaagatagtgtagttgaaaaagattgttaaggccgggtgcagtggctcacacctgtaatcccagcaatttgggaggctgaggtgggtgaatcacgaggtcaggagatcgagatcatcctggccaacgtggtgaaaccccatctctactaaaaatacaaaaattagctgggcacggtggcacgtgcctgtaatcccagctactcgggaggctgaggcaggagaattgcttgaaccagggagtctgaggttgcagtgagccaagatcaagatcgctccactgcactccagcctggtgacagagcgagactccatctcaaaaaaaaaaaaaaaagaaaaaaagaaaaagattgttgaaaatctatgaaccttgagtaccaacataataggaggagacaactgtgcagctacaatttatattataggccacctggccaaatgttggaatggataacatggtgacgtgtacaatggcaaaatacaagatcaggttgtggggtgggagggtttcaattaactagacatctgctgaaagttgcactgtctaaaagttgagtggaaaaattactgactttccttgctgacaatgtaaactttcatatggtaaataaagcagtaaggggaaatgcaatctcgaaccaaattctgacaagagtgcttagcaactgaaatactaggaaccttaggaaaaaaatcactgtaccatcttttagttcaaattcactgagaaagaaatgatgagaagaacgaagcgtgtatcttaaactttaaaataatagtactctaaaaattcagaaaaatgatatatatggctgtaatgggttgaaatgtgtccccctcccaaaatttatattaaatcccaacccccagtgcctcagaatatatatcattagttaagatgaggtcatactggagtagaatgggcccctaattcaatatgactggtgtacttataaaaggagaaatttggagccagacacagagggagaatgccatgtgaagatgagggcagagatttaggtaatgcttccagaagccaagcaatgccaaagatggccagcaaacctccagaagctaggagaaaggcatggaacagattcctcctcacagccctcagaaggaaccaactccctgacaccctgatcttggacttccagcttccagaactgtgagacaatagttgtttaagccacccaatttgtggcactttgttacggtagccctaggaaaccaatacaacgacttcaaggcctgacacactcattggaaagatgactcaaggaggttgaaagctcttaggaaatcctgcaattacagaaagttctgacgaggcaggaaaagaaagtatccaaaaaaccagtatgaccactaggagatgtgtacggttttcaaaagggaaaaaagtgaattttgtaaagtagaatctttatgttgattctgaaccaaattctaggaatggagtatcaatggactattcatagttacttttaaaaaaaagcactgattcgtataataagtcacagcaaaataaccataaaacccttggtgatgcagtgaattgtttgaaagactggcaaatagtggattaaaacgattgacagagatttagaaatatgggcctggtgagttttagtgggaagactcataaccagtatagatgaacagactgatctttttcttcagaggggtttatattattttgctgtaggtctttgtccttagctctggcttgttcaacatttttttaaacgaagaatcacatgagaacaatgatcaaatgtatggatgacaaaaggcttgaaaacagcaaatgcactggtagacagaatcagggtccaaaggtctaaaataccagtccacaccccaaaacatgaaatttcctagttgtaacactgctagtgggtccaaaaagcaaccatcaaggccagtgtatttttaagaacaatagcacatgtgaagcagacagggatttcaaatgatattaatctccacatgggttaacctagtgatggggctgcccatagctaatgcagttttaggctgtgagaacacctagagtgctgggttcaattctgtggagtgttcagagtgataaggatggtgagtggactacaaccatttcaactggggatattcagagttaactaaaggcaggaaaagaaagtatccaaaggaccaagatgtgtatggttttcaaaagggaaaaaagtgaattttgtaaaaagtgaattttgtagaaagcaagcctgacaagagtttttcctgaagggttttacgtgtgggagagtacacttactttctaacctcagaggatagagctagggccaatatgtaaaagtggtggtcaatatgagaaagcaacacatagagttgctcacaaatgtaagggattattttggggaagaaatgagtttcccattactgatgatgttcaagcagaaacaagattacttacttagtgtgtggtgtgtatatatatatatatatatgtgtgtgtgtgtgtgtgtatgtgtgtgtgtgtatgtatatatatacacacacacttttgtttattttttgagatggagttttgctcttgttgcccaggctggagtgatctcggctcattttgctcttgttgcccagcaatggtgcgatcttggctctatgcaacctctgcctcccggtctatgcaacctctgcctcccgggttcaactgattctcctgtctcagcctcctgagtagctgagactacaggtgtgcaccaccacgcctggctaattttagtatttttagtagagacagggtttcaccatgttggccaggctggtctggaattcctgacctcaggtgatctgcttgcctcagcctcccaaagtgctgggattataggcgtgagccaccgtgcccggcctacttagtatctttttaagggaattcatcattatatgggggtgagaggaagagtctaagattctgtgactccattgtgagacagtgggacttcacagttgagatatctggggccaggtgctttctcacgcctgtaatcccagcactttgggaagcccaggtgggaggactgcttcaggccaggagttcaagaccagcctgggcaacatagtaagactctgtcccaaaaaatattttaaaaatttagctgggagtggtggcacacacctgtagtcttagctccttgggagcttgaggcaggaggattgctcaagcccaggagttggaggctgcagttagttagctatgacagttccactgcactccagcctgggcaacaaagtaagactctgtcttaaaaaaaaaaaaaaaagaatctggtctggaatttcctctgcagagtgaaaagaatctcacataaacttccagagaacaaagtggatgaccttttggagcttaaaagaatgaatacttagcctttctctatttcctcatgtcagcagctacctggatatcatgatgtcttatcctccaaaccagtatttcagaggacaggagcaaaaataacaggacttggagttccttcgatctggaatcacttctccttaactatctatacttctgtgatagattggtctttctgccctgcaaatctggagtatcagggagtactcccagggctgactcatcatttagacatgctccccttacctcttaatgctcccaaacttatcaatatatatgacatcagcaattattatacttcttgtcccacaaggctaagctcatctgtcatcatgctagtaatacatttgaccattcattcagaagagggtaattaagaacaatttgaatcataattaattgatttaaaatatcaactatctagaaaaatgctttctgcttttaagcttgcatcagtgctcagttataaaatcaatcttactaacctccttgagcaaagctattggatgggtttacatccaaatgtcctggcactacctgcttaagcacagtggacattcttgaagtcctcctttcagtccctaaagtcagccaaaaagaagaacaaaaaccatgttgtttgggttaacattactcaaatgacaaaaagttatcttcaggtgtagcatgtttaactgctgccaaacattgtacttttaagtacccaaagctttattagagataacaaggcaatgttattattaatcagagataacacacatttgcaagattatagagagttaggtttggcaagtgcaatcagagaatttaatgataaatggagcaaggcatgcatggtgttattttacaagaaaagccactttctgcttatgttgagctaattcaaatagctgattaagccaaagagaccaacttctcaagtcacatgctcctgtgtctaacacattagggttacctctacatgaaccctttggggttccatcacatgataactgaaacagaatattagtacaagtcttaatggcttcatccaaatccagtgaaaacaaattgtactgaaaatcataataggctgcagatattttgggaatttcaaacttataaatgatgattttaataaatacacatttaacaaacatgttccacttacatattccatgtcataagaatattttaaagtctatgaaagataaatatgggaataaagggtgactttatttatatttcccacttcctctccaattactcttttgaaaaggaaataactgagctgggtatgataaatatgggaataaagggtgactttatttatattccccacttcctctccaattactcttttgaaaaggaaataactgagctcacacctcacacctgtaatctcagtactttgggaggctgaggcgggaagactgcttgagcccagaagttcgagaccagactgggcaacacagtgagaccccatctcttaaaaaaaagaaaataaaacaaaaaagaaaaaactgaatctctaagttaagttactatttactagacattaatagtggtagatttctaagtaaaaggagttaaacttataacccttcagggtaaaacttttaagaagtcttggtgaaggaacagtacaaataacaaataacagtacaaataaccctaggaacagaactgacctttcattagaagctgtcaagaagaaaagtattatcaaatcttacctggagatagagcaaaggctggcctgacagtaagagtgctgttgcctctgagtttctgatggacagaaacagcattcagtaaggcttgcaagtatttctcttgttctatgctactggaagattctaaagaggaggtaggagctataaaaggaaaatatattgaataaaataaactgtctctgtgttaacaaaacaagtatctatctatctatctatctacctatctatctatgcttatttttctctatatagtctacaagttaccacacccaaatatagaaaccagccccacttaaattgccagtctattaaatggctaatcctccactgtaatgctggttttaccacacctacttcttgattgcctcattatgcttccagaaagagcccaggtctggaaaaccagcacagggctacccttccaagcacagattgggcttgaaagcacagggcatagcttctcattatccaagcaactcaaaatgaagattcatgaacaacaacgccttgatgatatcccccaaccatcctgaccaggttattgcttgggagtgggttcctttgacatcccagaatgggtagagttaagaactttccaataccagcaactttatttcaattctgccacacaggcccaccaggggacatgagcctataaagatttgtagagggaagagtggaagaagatggggagaagataggagcaactactgccaatccctggtccttctaaatgaggagcaaaaagtatacacaattgtgagagcaattctgggttgatgggcatataagcctggtttgggtgaagcaaaacagaatcactgaaatcggcccagacagtttaaagaggacaggggatggactcactacaaggacaacagatattcataaattttcttacaacttgaatagaaaataaataattagcattattgtattttatcaactttaatatgtcatcaattctaagacgcactgttattttattgcctaacaataaaaactgcttatcaattaaaaaactgccatttaaactatgacactattctttctgatcacatcaattgtaagatgcattgcaatttcaaagatactagttgtcagccaggcgcagtggttcacgtctgtaatcccagcacttaggaaggctgaggcaggcagatcacctgaggtcaggagttcgagaccagcctgactaacatggtgaaaccccatctctactaaaaatacaaaaattagctgggtgtagtggcgggcgcctgtaatcccagctactcgggaggctgaggcaggagaatcgcttgaaccttggaggcggaggttgcagtgagccaagattgcgccattgcactccagcctgagcgacagagcaagactccagctcaaaaacaaaaaaaaaaaaacaaaaacaaaacaaaacaaaaaacaaaaaacaaaaaaaccctaaagatattagttgtgagtaaatgtggaagttgaatatgaaatatagtaaatttaaattagatttaaaaaaatcagcaaccagtggaataagtttcaattgttttccaactaaaagcttagtgatacgcttatcggtgctcccaaaatcattcactcattttacataacatatatgcttgtgttctattttactattattttatttcattttttttgagacagggtcttattctttcactcagggtggagtgcagtggtgcaatcgtggctcactatagcctttacctcatgggctcaagtgattctcccacctcagcctcctgaatagctgggactcaggcacgtgccaccacgcctggctaatttttgtatttttttgtagatatggggttttgccatgttgcccaggctggtcttgaactcctgggcgcaagcaatcctcccaccttggccttccaagtagctgggactacaggcatgagccattgcacctggccccttcttatgttctaacatacccaccaggtggcttgggagcacacagtgtttcagaggagaaatagtaaacagccaattgccttcaattacaccagtagtgagacttcaaggcaggtggaaggctgccctcagtcaacctaatgatcaaaacattggctgactttcaaaaagcacatggttgtacctggtgaatcacagattctgagtttacttcatttccaaaggtggaagaatgcagccatccctaaatcggatctgatatcttagtggcctactgtttcattttttttgagcatctattatgaggcagaagctatgagaaaggtcagcaaaatacagctcctgacttcaagacctcagacatggtactcacaagtatcctcagaatatgggacagctgtacttattatttcgctagcttcctaaaaacctctttgcttgaaagatcctgaagcagcatttgcagtcattagtttgctgtcttgtgtgtgcgtatgacttgtaagagtgaggatggatatctcatatcacatggcacagaagctcatcttacctctgaagctgttaaatgtatttggatgcttcccaggagaaagaaaaaagattggtataacctagtttccatctgtgaatactctggtttgctggaatgaaaattgcctaggaccaaagactttattatattaatttctattaaaatccaagtacagaccagacatattaagatgtcaaattcaatgtggagcctcacactatcaagtatagttcttgtttaagctgtacatgttgcatgtagcaaagtggaaaagtttgtgtgtgagacaagacttgatgaaaaggcaccattcccagattttacttcctttatttttagcactgtccttatgtgaacgggtggtaattgtgttatagagagatgcttaccggcctgaggggagttctgagatttgaaaagaccaacgactcccttcccatggaatcctccagatcggaggagcagagtaccacttcttgagttcttccaacatacaacaggcaggcgattgtgtcgatagcagcgagctactcttggtaaactactgtcctgtacagcttgaggtacgactaaaaggccaggatagcttcagagacatagaatagagaagagaatgattgggggaaggaacagaggggaagaaaaggggaaaggaaatgagagaagagggagacagagaatataagaaattgaatactaatatcatagtaattttctaagattcagaaacatattagttgaagggtaagatatatttattttcttttttaattttatttttatttttgtagagacagggtctcactttgttgtacaggctggtttcaaatttttgggctcaagcgatcctccttcctcagcctcccaaagtgctgggattatgggcgtgagccattgtgcctggccaacatatttcaaatatggaacttagtttcaacttctgaattcttcagggattgagaagaaaatccctagatggtgaaaatagctaactcatccactgatctgtagtcttttttgaaaagagccccattcactgatattgcagacttctgttgaataaacttagaaaataaaaatattatgtagaattctttaaaaggcctctgttgaactatttcccttgccttatacattacttttccacaacttgaaataaagatcgtaagattaccagattaatgtcaactttatgagaatgacaagtcaaattgtaaacaattcatagatcactgagatgacattagagaatacagcatgccaatattagactgcctgagatggtgaaaggcttaaaaaccaaaaccaaattatttttggcatgagaacaatttgttcaaatgtcaaatgagtttaaatagttaataacactacatgttgatacttattttaaaagattagcttataaagttacaggatatgatgctgggaaaataacatgtaagagtacacacagattaataaatgcaagaagacaggcaggtttcagagtcatttcttttttttagtttaattagaaatattacacaaaacagattttatatttataacctcctaaccactaatcctatatcttttttttggtgatttttttttttttttttgagatgcagtctcgctctgtcgcccaggctggagtgcagtggcacgatctcggcccattgcaagctccgcctcccgggttcacgccattctcctgcctcagcctcccgagtagctacgactacaagcgcctgccaccatccctggctaattttttgtattttcaatagagacggggtttcaccgtgttagccaggatggtctcgatctcctgacctcgtgatctgcccaccttggcctcccaaagtgctgggattacaggcatgagccaccgtgcccagctggtgatttataaattttgggaaaatatacctaacataaaatttatcatgctatccttttttttttttttttgagatggagtttcactgttgcccaggctggagtgcaatggcgtgatctcagctcaccgcaacctctgcctccggggttcaagcaattctcctttctcagcctcctgagtagctgggattacaggcatgtgccaccacgcctggctaattttgtatttttagcagagacagggtttctccatgttggtcaggctgtctcgaactctcaacctcaggtgatccacctgcctcggcctcccaaagtgctgggagtacaggcgtgagccactgcgcccggcccatggtatctttttatttattttattttttatttattttttgagacacagtttcgctcttgttgcctaggctggagtgcaatggtgcgatcttggctcactgcaaccttcgcctcctgggttcaagcaattctcctgcctcagcctcctgagtagctgggattacagacatgtgccaccacacctggctaattttgtatttttagtagagatggggtttctccatgttggtcaggctggtctcggactcctgaccttaggtgatctgcccgcctcggcctcccaaagtgctaggattcatgctatccttttttatgtgtacaaaccagtggcatttagtacattcccaatgttatgcaactaccaccactatccatttccagaacttcttatcccttatcttgataagaaccagtgctgacaggagggaaaggaaatctagtttatggtcacataaatcataaccttcaactactttactgaatgccaaattaactttccatacttaaccaatgataacttggaagcattctgaaagcctagggctttggtgatctaggaagctgtggcctgaatttttgtaataccacaaactgatgaaaagaccaagctatagacataatcactcatgaagactgaaaaggcagttccataattaggaccctctatctccacttgaatatcagtttttcccaacttgcttcaagatacaatgtgtattagacagggaaataatgtttaatggttccaggagctacttcaataatcggtaaagaacgagcacactccttcactccctgccccctgtagtgagccatctccttccactgtgaatgagcactacacacagaccatcctctgttacatacaagatctatggctctctcctgcttcctgacatgggcttgcatgacagctggagagcccctcatgctggggcaaattgtgtgaagcctaaagaccaagagaagctactcccagtaccagtctcatttcgtaatgaaagatatcaatttccctgccacccatcctaacccactactcagagccttcagctctgggctccacagttaactctcaagaggtagactaggcttcagaagctgttgtggaaactttttaattcaagcataattcacatacaaatgctcaaaacctaggtgatatcactaccacctaggtcaagaaattgaccactacaagcatccaagatctagtatttcctccaagtcactatttattcttctttcttaaagattaccactatcctgcctggcatggtggcttacacctgtaatcccagcactttgggaggcccagctgggaggatggcttgagcctaggagtttgagaccagcctgggcaacatagtgagacctcttctctacaaaaataaataaataaaataaaaagaaaattagacaggtttggtggcatgcgcctagtcccagctactcagaaagctgaggtggaaggatcgcctgagccagggaggttgaggctgcagtgagttggaatcacatcactgcactccagcctgggagacagagcaagaccttgtctcaaaaaaaaaaaaaaaagattactactatcctgactaacaatgtggatgaattttgcttctttttgaattctagataaagggaatcaacagagtttattctttcatgtttggcttcttttgctcaatattatgtttatgagatccatccgtgttatttgtactcacgtgtagtttgttcattttcattactgtatttcactgtgtgagtatgataccatttatctattctcttgttgattttgagtagtttctagtttttttaattattaagaatgttgccatgaacattcttgtagatgtcttttgggagcacatatgtatttctgttagaaattctactccacctaagaggagaatttctaggaattaggttatgaatatgttcagtagatgtttaaatgtttagacagcattagacaactttccaaagttatttaaccaatttatagtcctttttactctcttgatgatatctcctgatatacagaagttctaaatttatcaattttttactttatagataatgtttttcctatcccaagaaatctttccctatacctcaaggtcatggagacattctcttatcttctagaagctttattgttttaagcttatttgctttaaccttaataacaaacctattgttttattgttttaaccttttacatatagatctataggtcaatgggaataggtcaagattaatttttcccagcatcctttattgaaaaaacatcttctatccactgctcttaagtgttatttttatcttaaatcaagtatccacatatgttggggtgtttctgtttaatatattccctattttgctccactggtccgtttgtccattcttgtgtcagtcctatactgtcttaattactgtagctttataaaaactcttgacatcctatagtattattctgtaagactatcttggctactctgccttccacatttttatgtaactcttagaattaccttttcagtttccattaacattttgctgagattgggactgattctatagaacaatttcaggaaattcagttttagaatactgaatattctaatctaagaacctgaaatatctacttatttagctcttcaatgatcttcaatattgttttaagtattccatgtagaggtcttgcactggttattagattcatccctaagtaatgttttttagtgctactgtaaatagtaggaataataccaaaatagcatcactttttgaaaatttcattttgtaataatgtttttagtatatatataattattgtaaatgaccttgtactagtgaccttatcagtgaccttgtactaaatccacttaataattttaaaagtttattggcagattcctacagattttctacatgtgcattttggtcatctgtgagtaatggcagttttatttctttcttttcaatttttataccttttattacttttctagtctctttgcactgcctaagacctctagtacaacactgaatagaaatggtgataatgggcatccttgtcaggatttcagagaaaaagcttttaatattttatttatttctaagataagtaatttcctgtgtaggatttttaagacagaagattaaggagctacccactgttccactgtagacttctctgaggccttcagggcgctactcatgggagctcattcttactctcttttgctgagagcttttttctaaagatcacaaatgtgacaaaaaatacagaatttacataaataaatttacataaataaaactcataagtgtactttgcatttgcaaaatgcttatctttatataataaacttctttttaattctgttaatgtggtaaattacactgactgattttcagatgtgaaaccagtactctattcctacaataaactccacttgatcttaatgaattgctgtgtgtaaaataaaccttttgtcattatcaaccatcctttcttactgcttttaaagtctactttgatattcatatagtgacaacaactttttttaaaggtagttttgcgtggtatattttttctatccttttactttctacctttttatatacttgtatattagatttgtcccttaaaagcagcagaaagctttttttttggagacggagtgttgctctgtcaccaggctggagtgcagtagcttgacctcggctcactgtaacctccaccaccagggttcaagtgattctcctgcctcagcctcccaagtagctgggactacaggcacaagccaccatgcccagctaatttttgtatttttagtagacacagggtttcaccatgttggccaggatggtctccatctcttgacctcgtgatctgcctgcctcggcctcccaaagtgctgggattacaggcgtgagccactgagcccagccactttttttttttttttttttttaaagcaaaccctgatctctttctttgaattggaacatttagtcaattaataattaatgcaattatggatatatttgaatttaaatctaccatcttactacttgttatttattccatttgttctatgtccccttttttttcctttcttgccttcttttggattattttttattattccatttccttcctgctaataacttaatggatatatattactttttaccatcataaatgctttataaccagtgttctaataagtcatctattaaaattttattttacttctgacagattggaatgataaatgagtctgttttctcaatggctggcataattttgatagcaaactttccaaacagcaggacatcacaccccgacaacatgactcatcttcagagaaaatttagttagaatgacggagaattccagaaaaattactgcatactcagagtgccaatttttcagaacttcatgcaaaatgtttatttggccacaatctcaaaactatattcccaacttgtttctgaagtttcatattaatatttgtaaacttaaattgccatttaaaatgacatatctatcttcaagagcaacagggttgaaagtaacattaagataactttctaaaatatgtacaaagcttacaatttacaaagtgatttcagagctgtttaagcaggaatttataaatgcaaagaaaaatcttacctggagatgaaaatgactaaacttgtggatggtgaaaatgtaattttagaaaatatatatttacatatagtaaagcatggaataagactcaacatatttgaaaaacagtgagagatgacaagaactgaaaaaagaaaatgcctctttatttacatcctttaagtaatattcccttgaaaacattccaattagaccgcataagaaagccttgcctacacctgggtcagcaaattatagcctgtgggccaaaactggccatgcctactcatttccttactgtctgtggctgcttttgcggcacagttgaatagctgcaacaagagactctatggctcataaactgaaaatatttaccaactgaccctttatagaaagagtttgtggctccccagcctacaaaagactttcatgtcctctattgggctgggaaaatcctgttcttcaagttatctttagtcatgctagaaaagaagcaaactgggaagagaaagacaagagaaattcatagggggtgagtactttacctttcaccttctcacctactagaggtactttcagtaaggtaattgttccgagaatgccaatgagatgcttgctcgtatcctggagaccttgttcttattttcaggcatttttatctatctcagggctatggatgcaaatggcctattaaagattcaaataagaagaaaggaaggaagacctctttttggagcccactgacacacttacctccggcagagtgaatacatcctgttggaggcagtaattctaaaatactcgggtcttgaacgggaagagctgccacttatggttcctaaacctaaacgctgatagtctctgaaacaagctttttccaccaactgttccattgtagacttctcggaggccttcagggtggtacttgtggggagctcactctcatctgaaactgtgatggtagagacagatatcgaagaaatgattagctcaaagcaattgaggtcttcagggtagtacctgtggggagctcactctcatctgaaactgtgatggtagagacagatatcaaagaaatgattagctcaaagcaattgaggccttcagggtagtacctgtggggagctcactctcatctgaaactgggatggtagagacagatattgaagaaatgattagctcaaagcacaggattaaaaacttccttttgggctgggtgtggtggctcacgcctgtaatcccagcactgggaggctgaggtgggcggatcacaaggtcaggagttcgagagcagcctgaccaacatggtgaaatctcatctctactaaaaatacaaaaaattagccaggtgtggcggcaggcacctgtaatcccagctactcgggaggctgaggcaggagaatcacttgaacccgggaggtggaggttgcagtgagctgagaccgtgccactgcactccagcctgggcaaccgagcgagactttgtctcaaaccccgcccccagccgcaaaaaaaaaaaaaaacaaacccgctacttttgaagaagactcttacaccaagacaggtttatattaggatgacaagtattatgtatatcacaaattaaatcatgtaacttctgtgaggaatcacacttaaataaacataaattaaaagtgtaatgaatagtcaagaaataaaatatcagtaattcaactaaaaaatgtcaggaaaataataccatttaaataatttctaaaaacaatataattttgaattcattacctacactgttctgtttcatgaaggcttgcttattgtcaaattgcagtgatttctatttaggactctataaaaacacccaaagtttgtcagaggctaacccatcagtaaaatttatctttcataaaatcactatacaaactcatcatccagatttcagtttacttttcagactataaacttttattagaaatttctggattaaccagaagttcactagagggaaaaataactttatttcctcagagaggtataaaggagttacacttttttcctggaaatatttttgttagaggatgtggtgtacgtgggaaatcccctcacagttttacaatcacaggttacagaatcctttacaattttagatgtggaagaatttactcaataatcaaatattttagggaggcttttttttttttaaagaacattcctaattggtactgcatgttctaactggggaaaaaaaaaatccatgttaaaaactgtcctaatttacttccctatttattttgaaagtaagagacatcaaatcaagctttcaaagtttttgaaaatgtactcaaagtactaatgtgcaggcaaagatatggccctctttcattaaaatatattttaaaaaagcagaacatcaacaattaagtgtttcaatttgtgaacttcaattcatgtttccatttgtgaacttcacaatgcaatatcatcaggtatcaattctgtgttggcctttaattttcagaggagcaaagaacattatataatttggtcttttagtagaataattatcatagaataataggttttgttccatgaaatataaaaaaaattgagttagaagagtcaatagtgatgggtagcgataatatttttatggtttgacacatgactgtgaaaagatcagggttccaacaaatgggtgtggtgttatttcagtgatataatggtgggtattttcattgccccaaaggcaagcttgtatgtacatgttctcacccagggcatgcatacatacatacaaaaccacataggttcttttttttttttttgaggcagagtcttgctctgtccgacccaggctggagtgcagtggtgcaatctcggctcactgcaaccttctcctcccaagttcaagcaattctcatgcctcagcctcctgagcagtagggactacaggcgcatgccaccatgcctggctaaaattttgtattttcagtagcaacagggtttcgccatgttggccaggctggtctcgaactcctggcctcaagtgatctgcctgcctcagcctcccaaagtgctgggattacaggcatgagccactgcgcctggcccacataggttctttatcccagcaactgaaaatggagaccggttagccagtgctttctctgaagatgaggtttcttttttaaaatgttgttgttgttagtagtagtttttgcaaaaccaccggtgactgattctaagatcctgaggggaaaaaaagggtgtaatggcattctgcctcccattatatcagcttctctgtagtgctgattccatagcatatttgatactgggttaagaatgggaaacagtcactcagagattttgctactagctttctgcctctatttttcccactgagagatattgtagctgttctttcaaatatttagcaagtattttttcttatgacctaagtattccttcatcttaggtcccccattttgattaagagcaccaacaatgttcttaccaaaaactgaaatcttcaacttgaaatgttcaatgtccttaccttaaattcttattctagaaggataagatacaggggactactctatacctaaatttcccatgcagtggggttcccttctttcttcttttaatgagacacacataaaaatgaccaattagctgtatgaatttagtaaagaagtataatttaacaaaatattacctgaacaatgggatattgggaaaatatttttcccccagttctaagaagctggtaagtgcttccatcttctcatgagatctaggtttttgtgaatcaagatgtaagtgcaactacatctgagtctcttattcatataagaaataaagttgaataatgaaggaaattcaagttttcacataccagatacatcatcatcttcattccatccaggacgatttactctttcttccacaattgtccctgtcttcttcttcagtaaatattgccgcccaattgtcattttccctgcccttttggcacctttcacaattgtttttgagaaggtactacaagtcataaaaccaaagagaatgtcaacttaatataaaagcactacttgtattgttgacacctacttagctcaaattgtttcttctcctttcccacagccactactggtccagactcttgttaagcctctccttctttaggttacttttaatatggcagtagactaatttcccataaaacaccactgtcatcaggatactgtcttaggaaaaacgtgcaggaaaatgtaaagtgagacacaaactacttatcaccccaaatctaaactccttggtttagcttgtcggggaggactgccctgaacccactctggttatcctcatgccactgtccctaccacagttcccacaaagcatgcttgttggagtcctcctacatggaaagccagcctgcccacttctctacttactcaaactctctttctaccaactcacaagcctttctttgagatcatatggccttcatagttggcaacacatttgcttatttcttaactgttttaagtgtgtatatgtgatgtcctgactctaattagctgtaaactttaagaagcatagaaaaataatataattccccttttttgaaggagaaaaataagaaatcagaaacttgagtatccttttgagaatcagctttaattaaagggaaactaagatgtaatggacctagaagtactttatttattcaaacaatttaacccttcttgctgacagaaaatctaggcaatccagagaattaaacagagaacctatttcctgactaatcagatggaggtgaagactctgaagactgttcttgattatattcttctctatcacaaagaactcttctggtgttttcttgccattcagtaaaaagtgataaggcttcttttattatcaaatagtttcaccagactccatctttagttatttgcaatgtaaacctgaaggttatgaaacatgtttgagataacagctgggaatcataaaatactgatatttcctaaattaaacttattgtaaatcacttgtgtaacttttattttttaatttttattagtgggctttctggcaaaaactggaaagtctgctagacaaattctaaaagagctgtaacactaggtgtaacttaaactcaatgggatttttgaaattttttcccagctaaagctatatatatcttttgtttcatatacccaggcaactcttaaaatttttaaattgctacatctctgttgcagctgatataacaggcttgatacaggtatatatttctgaaactaatataaatatacatgtttctgatagtttctaaatgtaaaataccacacaaagctttgtctcttccattgaaggctgagataacaaacatcataggctcctctccgaccctatggtgctaagacaagatgcttggtccactgctgtaaatccctaggaacttgctcatgcttcagcataccatacctggatattacctggtaagcaaagctagacaggtggctagctgtgcaactgagaaataatatactgtctggaacctcaaattttctataatccccaatctacccttctttcaggcaaaggaagggcctcttttccaaagtctgcaaagctctccctagtattgtaatttgtattggcagatgcccgaattctacatggttaacagtgaatgaaattttagcccttatattttatcaccgatggaagataacttaaaactattgttatttcgtcataactgaagtttaaaactttcaacataaatttctaaaaactttctagaaaataagggttcatactaaagaaatatgacaactaaatgcaatgcctgatcctggattagatcctggaccaggaataaaaaagttaggtactaaactaaaaaaggatcattaacacaatgtgaatatagactctgggttagataaaagttttatattaattaaattttctggctttgattactgtgcttatataagataatgccggacaaggggagggatagcattaggacaaatacctaatgcatgcagggtttaaaacctagatgatggattgatggctgcagcacaccaccatggcacatgtatacctatgtaacaaacctgcacgttctgcacatgtattccagaacttaaagtataataaataaatttaaaaaacaaaataaaataaaaaacataaaaagataatgtctttgttcttaggaaacatattgtgatgtacttaaggataaagggacatcttatatctaactcaaatggctcaaaaaaaatatgtgtatatatgagagagagaatgataaacaaatggaccaaagtagaaactactggtgaatctgggtaaaatatatacagaaattctttgttctactgttatgaattttcagtaagtttgaaatgttcaagagttatgaaaaacagaaaatatagcctcctgtttctagataaaagcaaatctgtccactgggcctggatattaataaaagctgaagggattggtcaaaagcatttagaaagtgatcaatatggaaaaaagagaaaatagaatttcacattctaaaaatgcattgtgagcaatggacatgacagtcaaagcctctggtagcttttagtttttgaaacttgctacatttatcaatgctgctgttccgtaactttatgatcttggccccatgggcttgacagaaacagaacagtgaatgaaaacagcaatcgcttacacctggacacaaaggataggttactccttttgcaatcaattacgggagggctgaaattaacagacttgtctttcttcttaccgaaaagaagtgttcttttccttctgttttggtaaaattatttgtggggtagtttgtccagcagcaaaagcaaaggtactgaaaatggactgaggataacggaacttcatcagctgtttcttaaagatctctactacttctggactgacttcttcatcaaatgctaccttaatcaactagaagcaaaagagattaaacacaaaagaagcattaaggatttcctggcaactttcccccaaacaacagaatataataacacaaaatggcaagactggaggtcaaagggactttggataacatgcaatacaatttttaaatttttaaaaataaaaaaaggctcaaaaaggtttacttgccataaatggctagttggcaaggaaaatcatgtatcttcaagtcagtttctttaagattatttcttctacaatgggatagggaattgtatagcaaacacgcccttctcatttctcaactggttggttccagatagagaatttggcctaataaggtctcttcctacccagatacaacaaatgtaggaagaaaagaaatccatttgactagaatcctaatcagtacagctaggcaatatttgagtgtggagttctttggtagtcgggacagtgaggaaatccttaggcagccaatgctttcaggtgatgagagaaggtctggagcctaaagatcagcagccttacatttcacacaattagcatagaagccaataggagagatccttgactagaaggaaagaggcaagaactggcattcttagaaatctgagaagtgatgaagaataagacaagcaaaatattgcaaactgagaatttaagaacaggaaaaactaagaaaaggtcacttcttccagggtctggtttgcattattcaataattattgagttattgcagtaattctacaaagttctgatacagtcataaacccctggaaaacctcttgctttatcaggggtatgcaactagtaccaatagaactttagccctagctatactgtttacctttccatagaacagccacagggcatttccttcaaaacagatgacaagataattgctttttatctaaaggcttcatcaaacaggtattgaggtataacttggcagagaataagaaccaatcgtacttgtctaagtttctaagatcactcattattgagtatctgctggtactctgagttggctaaggggctccagggattaaatccaagactattcatgagtttactcagctgatgactaccctctcagaccctatgatcttccccattctcatcctcttaacttctgagcacatgaccacacaaaatggccataatatcatttgacttttgaaaatttttgaatagtaaaacaatggcttccttttttaatacctgaaaagatgctgatgtgatctgcagtccttcttgcatgttctgctgtagctggttctgcattgtaatcttcttctccttggtgatggaggcaatgggaaagctccgcacaactgtctgctcacccactgtaaatagacaggacacagcttcagcaacaacactttatagctcacttttagagtgtctactgcttacttcatcagtctctgctagagaaatgtatttgaagaggacactgcccagggatgcagtgaaagaaagtgcccttcactccagaaaaggattatgtctcaggagtggcaagtgacttacatttcacacaactagcacaggaagcagtagaagggatccttgactagaaggaatgaggcaagaactggaattcttggaaatctgagaagttagagacaagtgacttgccactcctgagacagagtcctttcctcgagtgaagaaactgtcacagcctgactgccttcattctttctatctccccaacctactgtgtgccacataagatcacctggtttaaggcaattttataggaagggaggttttacaaaaaaaaaaaaaatactcctcaagtattgaaaagacatccaagatatttaatataaggataaagcaaaagagaataggtttttaaagtttgtttcgaaatatgtaaaagatgttatactatatatatgtgcctttggaaaacaagcctggacttaagcgcaagacttttaggagtttattaaagcaaacatgggaaaatataaataattatttatcaagtacctgaggttatgaagatgagagtctagaaaaaaagtagcacactcaagacctcccttgaagagcttccaatttcccgtgggaggagagtcacatgcagaatataataatatgtggttagctcctacgtttgagggaacagtctacagggatttaaatatttcagagaaggatctctgcatgctagctggatagaaaatgatttttgggagaattgagagagaagatggagctttaaaggaagtgtagaatctggatttgcagaagggaaaggaagagcattttaggcagtggtagaggaacataacaggagtggcaatgaacaaggcctcccagctagtaagccagggtggggagggggtggggagatctgaactaggttcatcttatttaacagctcatacatttcttcatttattataatcagaatcctaattccctggatctatcaatctgtaatctagaaaaattctgactatattcttacatcaagctcatatccagaggctaagcaaagtcaggatgtacataggatttaagttctaggatgtatttaacacctacatttatataacatgtaaaattataatatttctatgtgtcatcaaaggataaattttaaattagaaatttaaaaggaaataaaaagattttctttgacaaaaataattttcctaagtgaaattaattcaaaatttgaaaggaaaaggcagagaatatgagatttcacactaagcatactttaaaataaataaattacagcaatttaaatgaccacataagcaaggaaaaggcagagaatatgagatttcacactacgcataacttcaaaataaataaattacagcaatttaaatgaccacataagtatcacgtttacgtgtccaaaatgtgtgtttatggccattaacctcacaaaagtcctactataaaaaattgtaagtactgcatagtttcttttaaaaatacgtttactttcaaatacaatttgtgtatagcaatatgaaggagcgggctaagacacttttctccttttcactttttcaaaataagcaaaactattcttacaaattcatctttccttatttaattttatgaactgttgcgcattatatggtaagcagtcttttatgactgatgtactaagccatcttgattctattcaacctaggaataatgcaactgttaagatttaaaagagaatacattttatatatctgaattcacttgtccaaccaatgagtagcacatagtgcatactcatcaaatgctactgcatacataatttcaaaggagaaaggcactttcgtgaccatttagcccagtggttctcaatcacaatcacttgtggggctaaagaaatacacagatgcctgggtctccctatttctactgcttcagattctaatacaattgtttgagggttgggcccagaaactggtatttttttttaaagattcccagataattcaaatatacagccaacattaagaaccactgaattatcaccaatgaaagcccaatctcccaattttataaaagaggaaaataaagtccagaaaggttaagtgatttaagtcactgagctttgacttggagtcctgttgttttgcccaaagtcttaattatgtgcttttcctatcaacaagagcattttacatatagactatagtgaatttaagaagataatgtagattacttctggtagggcatgctattcctttccaatatagaaggctgtactgaatagtagaaaatagaaacagaagttataggagtttggcaagtagaagagaagttgtctgctaaaagggaagtggagttaattggaatggaataagagggaagtgggattagttggtgctggacaaccttgtgatagttagcatatccttccacaaaaaggttcaagtatctgcaagaccttagttttacagttaactgtaggactcagaaagcgtggacaaaccagcaagggatatattcagcagttagagtgaatatctctagggtataacactctgcctcatgaaatgaaattatgatcatttcagcaaatgaacccttgatttattgtttagaagataacactttgttcttcaagtaaaaaactatgacccaaattatcattagctctgtcagactaaagtatttcaccaaaatacctgtgtggcaaaaagctgactttggatttaaaatgatctgcaaatcactgtgcacagatgggatcgagacctcatgtaccacacagatacccatgttctgatggcatatcgagtcatacctaactgatcatggggtgttcctctgaagagaattctgtatgtggtgaggaacaaggctccttctgctggcaggagctgagggcctccaagaagacctccagtagcttcttctcttccatcaggatccagcaagactcgaagaccctcacagacaatttcttctcctggcagcagagcaggtctaagaatcttgggcttacaacagaaaaagattgattgattgattgattgactaattgattgatttttggagacagggtcttgctctgttgcccagcctagaatacagtagtgcaatcatagttcactgcagcatcaaactcctgggctcaaaagatcctctgacctcagcctcctgagtagctgagactacaggcatgcaccactatgcctggcttatttttaaattttttttgtacagatgggatcttgctacattgcccaggctggtctcaaactcctggcctcaagcaatccacctgccccagcctcccaaagtgctaggattacaggcatgagccaccatagaaaagtattttaaacacaacttttgtggagtttctaatacttagtccatggttatcttttcagttacagacctaaaaaacttaagccagacttcccagatagtcacatgagaaacctgatttggtaagaggcagaaatgaagtttatatacccaaatgtgagaggattctttgcagaattgtgtaaaagtaaagtcattgagaaataactcaaatatctgaaatattcattcaatgaaacattttgtaacctttaaaaaatgacatagatctatatgtgttaacatggaaaaatatccagaaggctgggtgcagtggctcacgcctgtaatcccagcactttgggaggttgaggcagatggatcacctgaggtcaggagttcgagaccagcctggccaacatagtgaaaccctgcctctactaaaaacacaaaaattagctgggcatggtggcaggcgcctgtaatctcagctactcagaaggcggaggcaggagaatcgcttgaacctgggagggggaggttgcagtgagccgagattgtgccactgcactccagcctgggcaacagagcaagactccatctcaaaaaaaaaaaaaacaacaacaaaaaaaaacccagaatacatagattagttaaaaaagcaagttagaaaccagaatgtacattataatcccatttttggaaaaagaataggaattgtaagactgtgaacccaactgttaaaggcaatggtatcacagttaagggtggaggtggaggtagtatagggaggactgcaggggactttcactttctacaatgtgtatttcttttatgctcaaatttatacaaagaacattattacttttgaaattatttgcacattattttgtttttcaagaaaacaaaaaatatggacgagcttttaactagacctgtccttggccacgtaatgaacatttacacaactcaggaaattctgactcagtaaccatataatacattcctctgaagagtttagggctaggaaaaaaaaatctctcctgaaggtctaatatgtttattttttactaagcaataaaaactaatcagcactattatttttgttggctctagtgagtttagagctaaatgtaaagccaaagtataataatcgctgtgtctcaggtttctgatagaattatattcctacctacctgccttccgctcactcctttgactaaatgaatgaatttacctatttatttatttatttatgagactgggtcttgctctgtcacccaggctggagtgcaatgacatgatctcagctcactgcagcctcaacctcttggcctcaagtgatcctcccacttcagcctcctgagtatctgggactacagataacaccaccacggctggctaacttttacattattttttgtagagatggggtttcatcatgttgcccaggcgctggtctcaaactcctgggctcaagtcatctgcctgcctcggactgccaaagtgttgggattataggcgtgagccatggctcctggcctcaatttgtttttgttctattataaagttctgttatataggcaagagggtcctgaaccatagtctactggcgccagactacaaagtaatcatctgagagccttgttaaaatacagattcccagacatgttctggggtactccaattcaggaggctggggttgggtccaggactctgaatttttaatagactttccagctgtttgggatgtatagtcagattcagaaacctgggttttttatgataattgccttaaatcctttttggtggtgggggagggggagaaaataggcacagtataaaatcttgggttgggcttagaggttagaaatgttcctaatttatgccctgcctataaaagtagactcaatgagaggttattattgctcctttgttgaatctaagaaaagattctgttcctatttcagtatcctttttataaggttctatatgacacacttctctgacagtttaacatatcattaaaactggagttagtgtctgtcaaaggttaggtgaacatcctttcctggcacacagcagtctattgtttgtttttaagaagagaggctataccctgaaagcatgtagtctggaattaccttctgaataggcggaagtcttctgctttctcgatgtactgcttctagggtctcaatgtgcatagctacaattcctaggatgagtcagagtattcaaaatgaaagaacacagacaagcaggataaaaacaaattctggatattttagaattaaaagttaattacagtttactggttcctcaaaaaagttaaagagaattaccattatgacccagcaattccacttctacatatatacccaaaagaaatgaaaggactcaaacagatacttatatgtggatattcatgtattattatttataatagctaaaagggagggagaagtaactcaaatgtccatcaacagatgaatggataaaatgtgggacagccataccatggaaagttactcagccataaaaaggaatgaaattctgatacatgccacaacacgtatgaaccttgaaaacattatactaaatgaaataaaccaaacccaaaagtacaaatattatctaagtccacttatgtgaaatatctagaacaggcaactttatagagacagaaaatacattagaagttaccaggggaaacaggagttactgcttaatgggtagagtgtttggggtaataaaaaagttttagaaatagataacagtgatggctgcacaacattgtagatgtaattaatgccactgaattgtacacttagattattttatgttatatatgtattttacaacaatttaaaaacattttaaaaactaatcagaaaataaataaatagcatggctgaactataatggaagacatgtattgccaggttttatgctgaaactcaataatctccaatattctgattctctaatatctgcagagtgattacctggtatcatgcaatgaaggctcttgatgtgatcctgagtaactccactctctgtacaaactttgtcaataaatcgggtaatgaaccgcacaacagaattggcaatgtcagtattctctgaatcttcaaacccactctctgtatcatagctctcagctacacttcctgcaatactaagacagtcaaggaaagaaatcatggtcagtacttaaatgcaacaaatgactactatatagtagtcaatttacatagcgacagaaacatgagcaaagtgatgtctactcaagtagaaggctcacttaactccatggctccttggtaagtgatggtgataaaacacaatgttctactagtctacatttggaaactactgtcaggcagtaagtttctgtaaggaaatttgtttggacccagatttgtttctgtaaggaatacctttagtcactctcccaaaaggaatgcaggaaccacagaaaataaagcaaaagaggattttttcatttattatggactacctgggccttctaaagcaacctgtcctcccaagttaattattacatagagaacaagtaatacagctatctttggctacttggcaactgaggaacatgttccctggtaggcaaagtaagagaatttttctcagcaacaagcgtactcttccatatgtaaggaccaaactgtcccttctcttgccaggatttatcactctctgagttaactgcaacccatttggccactttgaagccagcattcttctgtagatgataaaatcatgcaagagaagggaacaaatttgaaatggaacagatgtgaaagctcaatctctgcccttcttgcttattcagctcttactgttcaacccatcagactctgggaaaagactcatttgtctgttcctattaacttctcttttctgcaaagccaaccacattagctgaatcagtgttagagattgttaaagtaaagctaagcagagactatggccatcaacatgcagactttgagagagcactgtcatctataatgattattatttgtttatatttatttatttattttagagacagggtctcactctgtcacccaggcgagagtgcagcgatgctagctgtaacctcaaactcctgggctcaagaaatcctcctgcagcagtgattctccagcctcagcctctcaagtggctaggactacaggtgtgtgctaccacacctgactaatttttattttttgtagagatagggtctcactatgttgcccaggctggtcttgaattcctggcctcaagcaatcctcccacttcggtctcccaaagtgctgggattataaggtagtcagccccatgcctggtccaaaactttaaaagaaatgtaaaatatagttattgcttgttataatgaagatgaacgtcactggcaatggagaatggagataaagctgtgacagctaaggaatatcttacaaattaaacagataggtcctgtattgaaacagagtcttgtggaattatgagtagtgaaggaatgggaaagcatcatttcgggaagatccttttggcagtagaaagaagaataaaaaatgaaacaactaagagactgttataattagggcttgaagtgataaaggccagactatgttgttcccattaaataaccagaggatgaacaagaaactctatatgggtgggggtaagagatctgtgcagttgactgtatggtgtgaaatgctgattccaagttgtctagcctggaagaccagaaactctgaggtgtccctgacaaaaatgaagtacctaggataacaagattaaaaggtttgggccagagatttaggcttgtggatgagtcttccacagagtaagaagagcttggaagaggaattgagaatgggaagagaagaggagctgcctgaaggagcatgaggagaagaatttatgcgagctcgaactaccaggatgttgcggcacccatcactgaagctctaaggatagaatttcactactgttgggttgataagttcatttattcactcatttaatcatctgttcaaccaaatatttattgagtactatatgcaaagacactaggaatacagcaatgaacaaaactgacaaaggaaacataacaagcaaacatatgaaaataaatcaggttgtaaaaaatgacatgaaagacaatgcaaagtaggagagggagaggtattattaagatgcagaagtcaggagggcttcttgaggcaagtaacatttgagcagagacctaaataaagtgaggaagtgattcttggcctgtttaggtgagaatattccagaatgaaaataccagtacaaaggatgtgaggcaggaatatgcttggagtgtctgaggattagcatgagcagggagaccagtttggttgacagaagagtgataggaaatagggggtcagagcagtagccagaggacggattccgttaggccttgcaggccatggtaaacactgggttttagtttcagtggtatgagaagttactggagggtagagaggaaggcatggttgagggtatgactacaaggttgaggaaaaggagggctgagaaacaaacagccacttttgcaagaaggtgctcactaatttctttggaatgatttctgtaaattgctttggcagacagtaactgaagggctggatcagtaatgggtgagacatttggaaaaattaggtcataaaaaagaagaaagtgtgggaagtggttaagaatagtaggatgaagtgaatcttttagaaagaaaagctgagcaagtccaaaggtgaggaaaaatggttaacttttgaaatatgtacagcagtatttgctcaaaatgtttaatattatctgtcaagccaagactggccccaagaagagtaggaggagggtctgtgtgttcacattttggtacctgtttgtgacaatgctgttgcttccgctctcccagtcacctggcgctgatgttcttaggagcttgtttttacttgtgtcgagtggaactagcaggttcaccatgaggtttgcaaagtgaatggcctgactaaagacagtgctttcctcatgttgcactagctcttgctgagttgacttgctcagggtaggccaaaggcgtagttgctcagctgccaggtccattgctgtcttctcctgataatggtcatcaggaagcttatcctaaaaaataaagcaacacaatccaaaagagaaccatcacttcaggtgagcttaaaaaacatagattttttttttttttttttttgagacggagtctcgctctgtcacccaggctggagtgcagtggcacgatcttggctcactgcaagctctgcctcccaggttcacgccattctcctgcctcagcctcccgagtagctgggactacagtcacctgccaccacgcccagctaattttttgtatttttagtagagacggggtttcaccatgttagccaggatggtctcgatctcctgaccttgtgatcagcccgcctcggcctcccaaagtgctgggattacaggcgtgagcaaccgcgcccggcctaacatagatgttttaaataactattctattaaatgcttaaatcagcaaaaatgaaaacataaacataacataacaaccacaaaacaaaacctagtcttctttcccagatccaacaggccttgagtggaactatgtgacaaacctcaggaagcagcagcaaagcaccttatagcttgtgaagagctggtatgtctatggtctcacttgtacctaacctagggctggctccgggatagacttctttagaatggctgacaaagaagcagtgacatgtgtttgctctatgaatgctttcgagatgtgtcaatattaacattacatctgcttaaaaaatgatcaaaagcacccccgaagcccagtaaatttctggagtagaatgataatcagccgttaaggctgctttaagttcaattcatgaggatgatagtttctaacacttattattactgcataccatgtactcttcaatgcactttatatatgagacactaaaatctcataataatcatatccattttaccagtgaagatataaggcacagtgaagtaacatgacttgccccaaaccagagagctagtaaatgatgttttaaactttcagagtatttaaaactactctttcaaattaaaaacaattttcttgatttttaaatttttttgatatttttcataaaaatattttatgctgataaaacatagagaaacatgtagaatattcctagaagaagacctagatttattactggcatttttttaatacaactaccaaattttacatttattttggagttaattaactttaatttgacattcctccagggaagttagttgcatagagaagtatgcctgttattttaggtttgttctttctattcaacttcctatagtcatttccaggaaattcttatttattaaagtatattaaaacaatcctagtgctgaagaactgtattaagaagttattatggaaaaacataatgtctgaaatcaacagaggaaagatatcacagggctccctaaataaaacccaaatacactggcaggaagtagctagagttttttttgccctgggaacatctgctttccttaaagccagaatcctaatcccacacaattagagttcttttcttctctcttaccttttgcttcagatgcggggcatgattgtcttccttggctgagagataaagggagcgaacctgttcctgcactgcattgtaaaaggttgtctcccaaaattgctgatttgtccaaatggggtggtcttgtacacacgtgtaagcaaactggctgactccaggggcaagtttctgtgagaacacacaaaatacatcatcatggggctggcagaattataacagttcataaggtcacaggggccacagttaatcatagatgagatcaaaggatttctctaaagaatatcgtatggtagtacaggcttagcaatcagcaacttactcctttttaactggcaactgtgggcttgctgttggatccttgagagtctcagtcactttatcaaaatgggtattttagtaacagctaaaaatcaaagctgttattatatcaattagaaaatacaggaaaaggaggcactgtaggtttagtgaatattattacaattagggcatataataaaatccatcacgatgtaaacataaaactccagataatttaacatttcttctatggctttagggtactctttttaaagagacagcaactgaaatatgagtgaacctacagcttggccttacacacagaatgaggatatagcatgaattagggactcaggagaactgcacttttcctactgctcattccagcccattacctccccgccaaagctgttgcctggctcacatactctctagaagactgccctgggcttcaagggcattttctggtaaccaaatttgtgcagggaaagataaacacaaaccaaacctccttcctttcagggacttcctgctgggtttcagcgtaagagtaaacttaagaggtgattaacaacagagggaaggaaaatgaactctgcaggcatttagaaggcacttcatatatatttaagtttgtttagttccaaaacccctgctctttttataacaccaaattgtctttcaaaagaactgaaagtaaatcaaaataaatgaaatgccaaattaactgccaattagcacttctgttttcccctcactttatgattttgtttcccaaagtaatattctaccttggaacctctgaaaaaaacttgtataacattgcattttaaattttaatgataatttacattgccaaatttcagttagtgacttgagtcaactttccaaaactatttctgccacctctaaaagctaaggatgtttcaaatttttaaaaattcataattttccaagaaagagtaggtaccattttcaataaacattttttggcccattttattctttggaattgagttcatctgttttctgtgagtagaactaaagtttctgataagttttctttcgaagcaatttaataagctgagtgtcttctcctgaaatgctggacactgaagatgattactaaggttatataactgttacacaacaaaagttggttcatttcttagggacgtataccagatatataagacatctggtaaaaattacacgctcaatacatgctaatctcctttttggtctagaactgcataccacgaaatgtagtacctgtgtagttagaagctgggtggttgtgattttgccttaaagagtctctgtgtactacatgccatctgtaagaccctttcaagataggactgtgttactgctgctgaggtaactggctataacctcaattctccctattaagtggctgtaagttgtggctatgaagcaaaaatcaggagttctttgagggtgcacagggatcattgttggatttcattatgcctatctgctcatttaagaaacagttactgtctacctatgggaaatcatgaacaaaatgtgtgtggttttgtgagtgcgtaagcagaagccacacacactgaatcacaagctccttctatactctgcatgaagacacttgggacatggattacacactttttcctccttcattttttagtcctttactgtaaggaccaacaattgtttcagtagcagtacacaagcctattttgaaacagtttttttttttttttttttgagacaaggtctggctttgttacccaggctggagtgcagtggcatgatcatggcttactgcagcctcaacctcccaggctcaaaagatcctcccacctcagcctccctagtagctgtagtagctgggactacaggtgtgctccaccacacccagcaatttttgtagcttttttttgtagaaaaatttgaacctgggaggtggaggttgcagtgagatgagatggggtttttgtagagatggggtttcatcatatttcccaggctggtcttgaactcctgggctcgagtgatccacctgccttggcctcccaaagtgctaggattatagatgtgagcccccatgaccagcctgaaagagattttaaaggcactaaattcaaatgagataaaactgtaattctcaactgcctttaccatgagtatactcagggcagtaccatttcttacaaatgcagcataacataatcaatggcaactctaaaaatgttgaagtcttgaaattatattcatatagataaactccaaaaaactgagcttttaacaaatccttatcagattctcacaaagtacttttaggataatcagcatgccaaaaaagttattaattaaacatcttttattaaaacttaacagagatgtacaggaatctgagggtgtaatgaagccccacctttcttcagtatttttcacactgatggtgtatatttgctttccttggcacatttgagttgacattacaggttgaatgtcccttatctgaaatacttgggaccagaagtgtttctgattttggaatatctgcatcatatttactggttgagcattctaaatctgaaaatctgacatctgaaatgctccaatgaacatttcttctgagtatcatgccagcccactacaagtttagaattttggagcattttgaattttctttcttctttttggagacagggtctcactctgtcacccaggctgatgacaatcatagatcattgcagcctagaactcctgggcttaagggattctcccgccttaacctcctgagtagctaggactacatgcatgtactgccatgcctggctaattttaaaaaatgttttttgaggccaggcacagtggctcacgcctgtaatccaagcactttgggaggctgagacaggcagatcactgaaggttgggaattcaagaccagcctggccaatatggtgaaaccccgtctctactaaaaatacaaaaattagctgggtgtggtggcaggcacctgtaatcccagctacttgggagactgaggcaggagagttgcttgaatctgggaggtggaggttgcagtgagctgagatcgcgccactgtactccagcctaggcaacagagtgagactccatctcaaaaaaaaaaaaaaaaaaaatgtttcttgaaacaggttttcactatgttgcccaggctggtcttgaactcctggcctcaagcaatccccccacctcggccttccaaagtgctgggataggattaggccaccaagtgtggcccaaatttttgaattagatatactcaacctgtatcttcatgtttatgcacaaactaaaagttgaatatgcaaaaactaatctaaatagtttgagcaaaagtgggactatatatgttccaaggaagaaaaacggtgcaagacagagtgacagtggcccaaagggtcagaacccacagcctgtttactaggtgagcattacagcagggtgaagtgactatagtacaaacacttggtggcaagacagacacaaacggctatggcatctgtgatagtggcagtagtcttagtaaacagagaaaataagtgcctgcagataaaatgatctcctgatatgtgcgttagaaatcattaacccccaaatacttaaaatattattctttttctagacatgcagtttgccttctttctttgtggtttcttgctttgtctggtcaaccacaagcagggagcactgtgtccctcagtgaggatgggcagggccattccactgatgggtgttctcaggaccagcagagggcagtatcactttattctgcctagactccatcatggcttgatctacaaattgcaaaaatggaactttgcagtcagcttgggctagaaagtgggtggtaaggtaaatatttcaggtgttcactgtgcatttgagagaatctataaagaaagagaactgttcagggtcatatggtaagatgagtagaacagatgggaacagaaataaagctttccattactctacgttgtttctgtaagatacaaaatgaacatattttacaaaacaaacctgtaatataattatgtagggaaagatgtaatgagactttagggtttcaaattcagtataacctgggacagtagcagtaattttagtaaacagagaaaataagcatctatggataaaactatcttctgattgtgataatttatttaaaaaaattttttttattattttgtgtttattttatttttttgattctaataatttctctggtttgaagaaaaactttcccaagacaagatggttttacaaattggtctgtatactagcatcataatcttttaatattgcacaaagatgagatttaactcatactgagggtgtgagatggtggtgctggttgggaatgcttttgtcaaatcacatctctctttcattctcttcaattctggcaacaatatttacatttcataataatttttaagattctgtcctaaaaaaaaaagtggtattgtgccatgcaattttatgagatgtttaagaatgtgttgacttccttctttatctagaaaaaacagcccgtgaaggtactagattaagcaatgccattcattttccacaaagctttcaaaggaaacccagcatgggacaggatatgaagaataaactcatggggctcaccaaccagcaggccagattcaaatccaaataaaggatgcaaatcatctgagagatgagatggttaagggaaaggttaagatatcagcatgaggggcctgttgaaggcctgtctggctagacatgttagttccccaagctcaaggctctcgtttgggagctcagggaaaaccagatttcaggaaagaaggctagctggcaggtcttttccataaacatgtaatggtcttaaagaataatagagagattcattgtctaaattgctggagatttcctatctagttctggtccctggaatataagtgtacctaactaactgcacaattcagggatggtgctagcaagtcctcctgtgattctgctctggcctgaccaagtccagatattaaatcactttaataattaattttagagcattttctgatgaaattgggagtctttcttttgcttagtcttgagagacaaacaaaaggaagacaggaatagaaaaaattgtatccaaaacctggctttatcaaatcttaaacatatttgctttgtccctccctctctctctttttttttttttttaaagaaaggacatacaatacatacaagtccactgtatacttctcctgattctatttctctcctatcctagaggtaaccatgatcatgaattacatattatcattcccattttgttttttacctgtgtatgtccataaagaatacataagttatattgcaggttttattctatcccttattgatgcttttcatgtatataactcatatttcatctatttatgtgacatctaacaactatataattaatcaggaacaaaacacaactggcttatgtaaacatacaactcagttagcaggagcagaaagagaatggcctataagcaatgagtatttaggatattatgctcattagttagtgggatttacagaatagtgagtaatccatttagttaaatgggatgactataagcatcttctacagtttttcctgttttactacctgatactcagattgaacagtacaagtatccttaaactcagaatggtctataacccttctagattgctcagatcaaggcatacaatttctgcacgagaggtatattcatccaccagcattgtccagtattcacttgatgtgccagattctataaatgtcagtagttgggatgaatggattgaagtccttttttatcaagacatagtctcgccttgtgacccaggctggagtgtagtggcacaaacaaggctcactgcagtcttgacctcctgggctcaagcaatcctcttgcctcagcctcctgtgtaactgggaccacaggcacacaccaccatgcctggctaatttctgtattttttgtagagatggggcctcactttgttgcctaggctggtatcaaactcctgggctcaagtgatcctcccgcctcggccacccaaagttctaggattaatgccatgagccaccaggcccagttgaactctgtttttaaaccatttagccttctaatgattctgtgtcttaagttgtttagtaaatattaagagttcagaggataaatcaatttctttcctttgtggtccagaaattggtagacatcaaatccaagactgttgtcaagtcctttgcctgggtttggtggtctcaaaaatataagatataatctaaattctcccaatcctccccatttttggccagtttttatttatttttttttttgagacagggtctcacctgctgcccaggctacagtgcagttggcacaatcttggttcactgcagtctcaacctctggggctcaagtgatcctcccacctcagcctcctgagtagctgagactacaggtgtgcattaccatgcctggctaattattaaacaaaatttttgtagagataggggtctcactatgatgcctaggctggacaactttatacaagtagtacaatgttgtgtttcattctgcaacttggtttttcatgcattatgttgttagatttattcaggtaatgagaattatctgacaactagaaatatctctgtaaaaaatatttaaaataagaaaaaattattataaccaacctgtactgagtataatacattctcagtataaatatttactgattcagttagtcctcacaacaatcttatgacccactgagataagtaccattatttctcctgtttaaaaatgaggaaaaagccgggcgcagtggctcatgcctgtaattctagtactttggaaggctgaggcacgtggatcacctgaggtcaggagttcaagaccagcctagtcaacatagtgaaaccctgtctctactaaaaacataaaaattagctgggtgtggtggcacatgcctgtaatccccagctacttgggaggctgaggcagaagaattgcttgaacctgggaggcggaggttgcagtgagccaagattgtgccactgcactccagcctggatgacagagcaaaactgtctcaaaaaaaaaaaaaaaaaaaaaaaaaaaaggcgggaggcgttggggggcgaaactgaggcaaaaagaagtaatttgctcaagggaacactgatagggagtgacagagccagagatgggatttgaacccagccagtttggcttatagagtcttgtttttcaactactgcacaatttaactattgtatggaattccatggtatgaatatacagcattttcttgtttctgttaatagacatttgtattatttccaactgtttgctattataaacactgatgcataaatatcatcatatatttcaactgccaactattaattattggtttcagtaccatttagtagggcctggaagtacttgacacgggtcccagtaaatgtggtaattctcattgttatctataccaataagcattttggggttattgcatattggttatttttctaataagaaattatttcatgcaaatattttgcaaatccactatttcaaaaaattaacaataattctttaatatcaggaagtcctagccttaaacaatcttaaaattcatatggaaacacataagaccctgaatagccaaagcaatcctgaggaaaaaaaaacaaagctggaagcatcacactatctgacttcaaaatatactataaggctatagtagccaaaacagcatggtactgccataaaaacagactcattgactaaaaaaacagaatagggaacccataaataaatctatgtatgcatagccaactgattttccacaaaggtgccaagaacagatactggggaaataacagtctcttcaataaatggtgttgggaaaactggatatccatatgcaggaaaatgagactagacctccatctctcaccatatacaaaaatcaaatcaaaatgaattaaagacttcaatgtaagacgtgaaactatgaaactactagaagaaaatattggggaaatgctgcaggacattggtctgggcaaagatttcttgggcaagacctcaaaaagcacaggcaacaaaagcaaaaatagacaaatgggattacatcaagttaaaaagcttctccatagcaaaggaaacaattagcaaactaaagaaacaacatacaaaatgggagaaaatatttacaaactatccatccatccaacaagggattaataaccagagtatacaaggaatgcaagcaactcaatagcaaacaaacaaacaaaaaaagggcaaatgattgagcagacatttcttaaaagaagacataaaaatggtcgacaggcatattaaaaaatgctcagcatcactaaacatcagggaaatgtaaatcaaaaccacaatgagatgggtacaaaaaaatagaataagacctagtatttgatagcacaacagggtgactacagtaattaatggtttaattgtacatttaaaaataactaaaagggtatataattggattgtttgtaacacaaaggataaatgcttgtggggatggataccccattttccataaagtgattattacataatgcatgcttgtatcaaaacatttcatgtaccccataaatatatacacctactatgtacccacaaaaattacaaattaaaaaacacaaggagatattatctcgtcccagttaaattgaaaaacacaaggagatattatcttgtcccagttaaagtggctattataaaaaaaagaaaaagtaacagatgccggtaaggacacagagaatggagaatgcttgtacactgctgatgggaatataaatgagtatagccattatgcaaaaacagtagtgagattccttaaaaaactaacagtagatctaccataccactgctggatatatatccaaaaggaagaaaactagtatatcaaagagattacatttattatagcgctattcacaatggccacgatatggaataaacctaaatgtccatcaacagatgagtggataaaggaaacatggtatatatacatagtggaataatattcagccataaaaaagaatgaaatcctgtcatttgcagcaacatggatggaactggaggtcattatgttaaacgaaataagccaggcacaggataaatatcacattttcacacatatctgggagcaaaaaaagttcatctaatggaagtagagagtaggatgatggttccaagaagctgggaagggctactgggaagggggaataaacagaggttggtaaatgggtacagaaatacatttagaaggaataagttctagtgtttgacagcacagcaggtgattacagttaacaataatttattgtatatttcagaatagctagatttgaaatgttcccaacacaaagaaatgacaaatgtttgaggtgatggatattctaattaccctgatttgaccattacacaccgtatacatgtatcaaaatatcacttgtaccccataaaaatgtatacttatgtaacaataaaaattctttaatatcaaatatctagtcattgttcaaatttacaattgttttttaaatgtaaaaaagttgttggggcgcagtggctcacgcctgtaatcccagcactttgggaggctgaggtgggtggatcatgaggtcaggagattgagaccatcctggctaacacagtgaaatcccgtctctacaaaaatacaaaaaaaaaaaaaaaaaaaaaaaaaaaaaaattaggcgggtgtggtggcgggcgcctgtagtcccagctactcgggaggctgaggcaggagaatggcatgaacccgggaggcggagcttgcagtgaactgagattgcgccactgcactccagcctgggcaacagagtgacagacaaaaaaataagtaaataaataaataaaaataaaaaaaaagtttgtctttgtttttctgttatttttacaatcagtttgcttaacttgagtaggaattaaggtcaaataaggtctacatattaccattagtttgtatattgctagcatcaattttattctagtttctttttccacctgcaatttatttgctgaagaaaccggatcatttgtcctagaaagtttccatcagtctgactgcatcccagtggtgacatctgacacatttcttttgtcctctgtgttttcctacaaattagtagttgaatctagatgcttgatcagactcaggcttgtttggcaagagtacttcagacagtactagcctgaggggtagcactcaccgggcacatctgtttgtctctccttttgttatgttagaggatgttgattgtcaatgcccagatttgttaatattagaagttgtaaaattgtgatattctaattctagcattacttcctcactcattagttagagtacttcgatcaagagaaactttcccttatcaactgttggtgaaccacaggcatagcctgtattagaaaagcaggataaatatttgattctatccctttgtttaacaattttaaaagcaataagttgtttttctagtgtctaccacaggtaaccaattagtttggtttttaaaaattaatatctctatcaacccataaattttaaaacatattcgattcactattaaattattcttaaatctgtttagaaacaaaccctcccaaaaaatctatccataagagttccctgaaaatttttttttcttttttttggagacagagtcttgcttagttacccaggctggagtgcagtggcgcgatctcagctcactgcaacctctgcttcctgggttcaagtggttctcgtgcctcagcctcccgagtagctgggattacaggttcatgccaccatgcctggctaatttttgtatttttagtagagacagggtttcgccatgttggccaggctagtcacggttcaacatatgcagatcaataaatgtgatatatctcataaacagaactaaagaaaaaaaccacatgattatctcaatagatgcagaaaagacctttgataaaattcaatatcccttcatgttaaaaactgccaataaactaggtattgaaggaacatacctcataataatgagagccatatataacaaacccacagccaatattatactgaataggcaaaaactggaagcattccctttgaaaaccggaacaagacaaagatgccctctctcacaactcctattcaacacagtattggaagttctggcccagggcaatcaggcaagagaaagaaataaagagtattcaaatagaaagagaggaagtcaaattatctttgtttgctgatggcatggtcctatatctagaaaaccccactgtctcagcccaaaagcttcttaagctgataagcaacttcagcgaagtctcagcatacaaaaatcaatgtgcaaaaatcagtagcattcctatataccaacaacaggcaagcagagagccaaatcatgaatgaactctcattcacaattgctataaaaacagtaaaatacctaggaataaagctaacaaggcaagtgaagcacctcttcaaagagaactacaaaccacaggtcaaaaaaatcagagaggacacaaacaaatggaaaaacattccatgctcatgtatttgaagaatcagtattgtgaaaatggccatactgcccaaaataatttatagattcaatgctattcccattaaactaccattgacattcttcacagatttagaaaatactatattaaaattcacatggaaccaaaaaagagcctgaatagctaagatgatactaagcaaaaagaacaaagatggaggcatcatgctacctgacttcagactatactacaaggctacaggaacccaaacagcatggtattggtaccaaaacaaatatgtagaccagtggaccagaatacagaactcagaaataagaccacacacctacaaccatctgatcgttgacaaacctgacagaacaagcaatggggaagggatttccaattaataaatggtgcttatagctatatacagaaaattgaaactggacctcttccttacaccttatacaaaaattaacctggccgggcacagtggctcatgcctgtaatcccagcactttgggaggctgaggtgggtggagcacaaagtcaggagattgagactatcctggccaacatggtgaaaccccggctctactaaaaatacaaaaattagctgggtgtggtggcgcacgcctgtagtcccagctacttgggaggctgaggcagcagaatcgcctgaacccaggaggtggaggttgcagtgagccgagatcacgccactgcactccagcctgccaacagagtgagaatccgtctgaaaaaaaaaaaaaaaaagtaactcaagatggattacagactaaaatgtaaaatgcaaaactatcaaaaaccctaggagaaaatctaggcaatacttttcaggatataggcatgagcaaagatttcataatgaaagcaccaaaagcaattgcaacaaaagcaaaactgacaaatgggatctaattaaactaaagagcttctgcacagcaaaagaaactatcatcagagtgaacagaaaacctacagaatgggagaaaatttttgcaatctatccatctgacgaagatctaatatccagagtctacaaggaacttaagtagacttacaagaaaaaaagaccccattaaaaagtaggcaaaggacatgaacagacacttctcaaaataagacatacatgtggccaacaaacatatgaaaaaaagctcaccatcactgatcattagagaaatgataatcaaacccacaatgagataacacctcacaccagacaggatgacgcttattattattattattattattattattattattattttgagatgagtctcactctgttgcccaggctggagtgcagtggcgcgatctcggatcactgcaagctccgcctcctgggttcatgccattctcctgccttagcctcccaagtagctgggactacaggtgaccgccaccatgctcagctaatttattgtatttttagttgagacggggtttcaccgtgttagccaggattgtcttgatctcctgacctcgtgaaccgcctgcctcagcctcccaaagtgctgggattacaggcatgagccaccgtgcccggccaggatgataattattaaagtaaaaaaacaacagatgttggtgaggttgcacagtataggaacacttttacactgttggtgggagtgtaaattagttcaacccttgtggaagacagtgtggtgattcctcaaagatctaaaggcagaaataccatttgacccagcaatcccattactgggtatacgcccaaaggaatgtaaatcagtatattataaagatacatgcatgcatatgttcattgcagcactattaacaatagtaaaaacatggaatcaacccaaatactcatcaacgatagactgaataaagaaagtgtggtatatatacaccatggaaactatgcagccatgaaaaggaatgagatcatgatctttgcagggatatagatggaggtggaagctattatcctcagcaaactaacacaggaacagtaaacctaacactgcatgttcttacttataggcgggagctgaaagatgagaacacatggacacatagggaagaacaacacacactggggcctgtcagaacatcaggaagaatacctaatggatgctgggcttaatacctaggtggtggcatgatctgtgcagcaaactaccttggcatacatttacctctgtgataaacctgcacatcctgcatgtacccctggacttaaaataaaggttgaagaaaaaaataagtaaaaattaaaaagtctaaatacgtgaacagagatttcaccagagatgatatattgatagcaaatacaaacatgcaaagatactcaatattattagtcattagggaaatgaaaatgaaaatcacaataacctactacttcatatctacaagaatggctaaaatgacaaacactgacgtgtggatcggaggaactggaactctcatacactgctgaaaagaatataaaatggcagtactatggaaaaaatgtatttttggctgggtgcaatggctcacatctgtaatcccggcactttgggaggttgaggcaagtagatcacttgagatcaggagttcgagtaaataataataataaatgctaagccaaataaccaaaagaaacctctgaattcagagttcaacatagttgtgtctgaaaagtacatcataaaagaagaacagggacctctgtttttgtaataaactgtaatctttatatttctgaaatgtatacatatatgccatagatcatgaggtcaggagatcgagaccttcctggctaacacggtgaaacactgtctctaccaaaaatacaaaaaattagctgggcgtggtggcacacacctgtagtcccagctactcaggaggctgaggcaggagaatcgcttgaacccgggaggtgcaggttgcagtgagccaagaccgcaccactgcactccagcttgggcgacagagtgagactctgtctcaaaaaaaaaaaaaaaaaaaaaaaaaagttactaaaaaatgctctatgtagtttgtcacaaaggtttaaagtgatatggattagtacagcataaaaatattggttcacaaccacaaatggtggttatagtcattcaccacagtctgagaattcaaaagatatgttatggaaacaaagctaagaagattatggtgtatgctgctaacttcatttcagggcagctctagcacatgaaagtaagaagatccacttaatatgtatttagtaaacagaagcagcagccaggggctcaagggatagtgggggcagcagcatagttgcacaaggtcatggtacaacagcaggaaacccacataggcagacatagataactgggaaatagaagtatctgcctaggtagaggaacagtgagcagttttagggatctgcatgagcagtgaggaggcatatacctagaaagttggctattatttagctccaaagagctttcatttagtagttcagcactatattaggatttaaagaaaagacaaaagtaagtcccttgaaagagcatatttctggccgggcacggtggctcacgcctgtaatcccagcactttgggaggccgaggcgggtggatcacctgaggtcaggagttcgagaccagactggccaacatggtgacaccccgtctctactaaaaatacaaaaattagccgggcctggtggcaggcgcatgtaatctcagctactcgggaggctgaggcaagagaatcgcttgaacccgtggtctctcaagagatggaggctgcagtgagccgagattgagccactacactccagtctgggagacaagagcaagactttgtctcaaaaaaaaaaagagcatatttctttccttgtgtgactgagctttagagtttaaatcctctcattaaatctgcatgatattattactatcttagagactaatgacaaagagaatctagaaaaaaacataattaggaagctctcattctaagtcatttttaacttgaatttttattgccaagtacataatagtgaatctaagtaaaaacttattccttacactattttctacttcttactagatgaaggcagaaatcacagtactactgaattacagttttatagtatgtctcttctttccttagtttctatctactcaacttttccagagacccctaaaaaaattatcagagatacaaaaagcaaagtcttaaaagcatttcctataaacaagaaaatcaatatcttttaggggcccaattttccaaatttcactgacattttgactaaaaagcttaagactcttgtcaatgaccaaataaagactcaaattgtaggatgcctccatgatatagtcaactgtgggtgcatttaaactgtaactgttacttcagtgcctacactttctaagggttttattttgatgctgtggtcttctgagaatgagtgacagccagccagtgtgattcactgaggtactgcctacacaaattagaggctacaaagcagtaaatatggggctgggccttgaagaggctctgacttacagaatattattggataagtcacctaagctcctagcttaagtttattattaaaataacacctcttgacttgcatgtacatctgctaaaagtagactaacctatcaaccttgaagagccaatagtacaaaaagttaaaatgttatatgaagagaaaggagaccaacctattattggaagaaaaacagcattgtaagctgattataagaacatttatttattgaggagaaatatgcctctgttactgaggaaaacagctcttcaacttatagactgtatttattttggaaagattgattaagactgagcctctagaatgagagacaagctgtttacctagtggccatttcccaggaagaattatctatcaaatcatatagactgggtcacaaagttctccaagtatttgcatggttaagccaataattatgcctagaattctagaaaatgagtaaacagcagtaattatctggttaaaaataaccaagacagatccagtgctaagaataaatagctataaagttacattaaactgttctaggactgcagatggttttcaagctccagaggatcatttctcacttctaaggcttctaggaacatcataaaatccaccttcctcctacccacgagctcctctttttattaatgtctagtggtttgctatttatgtttcatttgtacagtttaaggcctacttcctaatacaaaacaaatgttactgcaggcctgaggatacctttacctaattgtccataaccgaatatgaaagaaggctttgggattaagtttccataacaggatagaaagaccagttgtgagggaaatgaagtcaaaagcaggagaaaataacagggccagtgaagtggaaaaaagggtgtggaacaaggcagggtcagccatatatcttctctatttgcctggtcaatcctccctgcaaggtccagtttgggtgcttggaatatgctgaataagcttcccaattcatggaggggtaggagaaattgaaattcaacttaggaagccaaaatagatttttctgcctattatcaaaaatttgcagaagctgcacatctgctggtgtgagacacaaatgtgaaagtatgcaggcacacacaaacacataacactcgttaaacttaaatcacttaacttgttattaagtgtaaactcactgagttagaataaacctcagagattttttttttttcactaatacatgggaacgccaagataaacggaagaaaagaaacataacaaaggtcatacagctagacggagcagtgctgaagccagcatcagatgttttataaggtattaaacgatctggtcacatcctccctttctcaacttcctgaatactattcactcctgtaggtgtatcccacagttgaacgagttgaatgctctgtgtactaaacatactctttgctttctccctgccatgacattggtcaagctgtttcatctacttggaatccctccttccaatctctagtggttaaaatccattctccaagggcctattcagatgatacctctttcaaaatgccctccctgtttgctctctctttatttactatgtgttataaactgaatgtttgtgtcccccttaaattcatatgttgaaaccctatctccatccagcgtgcccatatttgtagtaaggaagtaattaaggttatatgaggtcataagggtgaggccctgatccaacaggattagtatcctgagatagagagcttgttcttgctcttgctctctctctccctctctccccactgccccacgttctgaagaaaggccacgtgacatagtgataaggcagccatctgcaacccagaaagaaagccgttcccagaaagtgaattggctggaactttgatcttgagaaaataaatttctgttgttaaaatatccactctgtggtatttcgatatggcagcctaagcagactatgacactatcttaagtagaactttgttgttgttgttttgagatggagtcttgctctgttacccaggctagagtgcagtggggcaatctcggctcactgcaacctctgcctccttggttcaacaattctcctgcctcagcctcctgagtagctgggattacaggcgcccaccaccatccccagctaaattttgtatttttagtaaagacagggtttcaccatgttggccaggctgctctcaaactcctgacctcgagcaatccacccacctcggcctcccaaagtgttgggattacaggcgtgagccactatgcctggcctagaactttgtttatacttctttaacaattatttcattctattttgtattacatttaggacagttttttgctctagaatgtgctgaaatgctatgctacaaccttccttaggcttgatacaagataaaatagcagccataataacaatacaaagtattagtatttctatgacaacaatgatgatcaaggtagagtttttaaaaaataaataatactctaccgttttataaggaaatgtattatatgaagtaagttcctgtgttgttcctatttttgtatgctcattaagagataatatttttaaaatgccaacaattaggttttaaaaactaaacatgaaatcattaattaaacctaaataattttttaaaattatactttaagttctagggtacatgtgcacaatgtgcaggtttgttacccaggtatacatgtgccatgttggtttgctgcacccatcaactcgtcatttacatcaggtatttctcctaatgctatccctaccccaatccccaaccccccgacaggccccagtgtgtgacgttccctgccctgtgtccaagtgttttcactgttcaatcctcacctatgagtgagaacatgcggtgtttggttttctgctcttgcgatagtttgctgagaatgatggtttccagcttcatccatgtccctgcaaatgacatgaacgcatccttttttatggctgcacagtattccatggtgtttatgtgccacattttcttaatccaacctatcattgatggacatttgggttggtttcaagtctttgctattgtgtatagtgccacaataaatttacgtgtgcatgtgtctttatagcagcatgatttataatcctttgggtatatacccagtaatgggatcactgggtcaaatggtatttctagttctagatccctaaggaatcaccacactgtcttccacaatggttgaactcatttacactcccaccaacagtgtaaaagcattcctatttctccacatccgctccagcatctgttgtttcctgactttttaatgaccgccattctaactggcatgagatggtatctcattgtggttttgatttgcatttctctgatgaccaatgatgatgagcattttttcatgtgtctgttggctgcataaatgtcttcttttgagaagtgtctgttcatatcctttgcccactttttgatggggttgtttttttctcgtaaatttctttaagttctttgtggattctggatattagtcctttgtcagatgagcagattgcaaaaatttcctcccattccgtaggttgcctgttcactctgatggtagtttcttctgccgtgcagaacctctttagtttaattagatcccatttgtctattttggcttttgttgccattgcttttggtgttttagtcatgaagtccttgcccatgccaatggcctgaatggtattgcctaggttttcttctagggtttttatgaattaaacctaaataatttaaaaaaatctgtgtacatatagtctgtctcttaatagcctttgagggcagagaccatgtcttgcacatcttggcatcaattcaaatgctaggttaaagcatcttaaatataggtactggaggtacacacaatgcttgttaaattccaaaaggttaattacatatttcccagaggcttgcttctaagattataattttaattctaattttattagctggaaatgtcacccaagagtataataaaaccagctaactccacagtcattcaagatggctctctgacttcttccaggtaatctcctgctatcagtactgaaacatgcctatgaccgagggttaagctcatgctttcatctccccaacacttaaaactccctctgaaagtgacccctctttatctttacgtctctcttatcatgtaaaaatctatcagtgacaaagaggaacaactgcaaagctgcagaaattaaaaacagaccttttgacttaggtacaaaatgtttgcactttggacataaagggaatttgctgagttactgaatcaagtatttatagcaccacataattgattttctgccataataatttcttctgtaatttagcagctcctccacaaatccccatcaaatctatgacttctcaaaaatgctaacaatgctggctaatacaaaggaaacagtgccacctaagcaaaattaaactagaataataatctattcataaagttctttttagggacacatagttattaaaatctttgcttttgttattcacgagtcatgagttttgcattttccattcttttctcaattatgttattaggctgtatcttatcaaaagtattctaattcctatcttcaggctacaaagtccttgccctaaatgaaaatattagagtccactaaaaaccaacataatcaagtatgccctgtgacttccaaccccaaaagtggaggatgctgacatgcatcatcatcggttttgccatttgccagctggaggacctgggctaagcttggtgagcatagggactgtgtctgttttatttgtcaatgtatatccagtgactggtgaagcagacattcaatttatagttgaattcatgtcctgtctttcattcaacaaatattcgctgtgcacgtactatatgccaggcactaggttaggtgctttacatgaataatttcatctttagttatcaccattttagagtagaagaataaaagttcagacagttaaacatttgtttcagatctcaggatgaggccaggcttggtggttagtgtctgtaatcccagcactttgggaggccaagatgggcggatcacttgaggtcaggagttcaagactgccctggccaatgtggcaaaactccgtcttcactaaaaatacaaaaattagctgggtgtggtggtgcacaccggtattcccagctactcgggaggctgaggcaggagaattgcttgaacctgggatgtggaggttgcagtgagatgagatcgtgccactgcactccagcctggacaatgagtgagactctgtctcataaaaaaaaaaaaaaaaaaaaaaaaaaagatctcaggatgagccaagattcaaatccagatctttctgtggccccagagttcaggccttttccttactataccacacaacaacaattcacaatcagaagctaaaagctggaggttgtgaagcttgcatgttattaactatatctggctgagtatgtgttttgttttggctgtctaggatttttgaaaaatgaagccaacattttaaactgaagaggttttacatacaatctaaatttcgcgcttcttttgaaaagcctaaagatgtggtagcaatgttcctacatccctgtatggcaacaactgctgaagctaagcagaggctgccccttagatgggacatgtgctcttcatgtggcctgctaactcatttgcgttatttgtttggcccctgtagatttggtttgtaacttctgctacctctatgtggatctctaagtaccctcatcagtgcttgtctattatactagcctactaagtggcctctgttgctctaacccctcatcttcctatcttctacactgctctagtttgtttctgaaacaatcacgtcactgccctactcaagagtatggtattacgtactccttagtgaccagagaataatattagtctaaactccttaacatgacattctagacattctgtgatttgatttcaaattacttttcctgtcatattttccttgtctaatgactgcatggattgcagctatcctagaagggggtgtctagtagcctgctacaaaattctgcccctgtcagcattttaatcaatggcttggatcacaagaaatatgattttcaaatttaagaaggaggaaaaggaaacctataatttatttatatccagcctcagaaatgcatgccttaatccttttactgcctacagaagactctggcaagtgcttaacaaaaagatctggagtcaatggtggttttaagattatgtacaagccactcacagagatactagtgctcctttgcccttttatagcataaaaaggcatttttggatatagaatctcatttcttcaagtccaacaacaaaaataggatgatagataaaatatttaaatgaaccgaatgagtgattaaataaagtaagaattgtatttggacagaaagctcttggcacagcagtgatacctaaggataaattataaccatgaacatttttcagaattccaaagatgtgttcagcactctgctgggggctgggatggtgattctaaaatgtactatcacatatgaggctcaaaacgctggggtgaagccagtgaaactgataacacagttgttttaggaagaacgagtaactgttaattgttacacgcatctcatctctcataactacagagagagttaagctataaaaatttagtttattaattccaaataaggggaaactgtccagatacttttcccccgccttaatccttctagaggattcaaatctcactcctggtggactgatttctcatgataacactttggcatggagcatgcccagagttcagctgcaaggcacttcccagaagtcatgtcagcttcagctagccttcttggatggaaaagagaacagattttagctttggccaagtagagtctctacaacactccccatccccccccaattaaacaaataaagttgattttgtaaggaaaacaataaaagcctgggcaacatagcaaaaccccatctctaaaaaaaataagaagaagaaataggctgggcgtggtggtgcacacctgtggtcccagctactaaagaggctgaggtagcaggatcccttgagaccaggagtttgaggctgcagtgagccatgattttgccactgcacttcagcctaggtgatagagtgagaccttgtgtttaaaaaaagaaaaataaagcacaaatgtgttgtttttccacagctctccttgtaacaccacagatctttacacaacataatgagtcaagttgttaaacatgcaattcggaaaacagttacttagtaaagagacaacaattccagaccaatacaaatgtcaccttaacttgaaagacagcaaaaatgcaagcagtcaccagacaacatttcagaaaatgtatcctagggcttgcttgagtgaaaacaaacctcttcataattttttaaccttgaaaactctgcatttgtacttttgttgtttttagaaaatttcctacaaaattcacaagattaggatgaagccagtaaaatttttattgttaccatgaggaagaataattgttaatggtgacacaatatcctaaatcacagaaggtatacaattgtctaacttcagcagatatctgtaatatgtaatttagtgttgaaccactgatttgcacttccatacagttctgtttttgtgaaacttctgatacagtgcttaaacataacttctcggccgggcatggtggctcatgtctgtaatcccagcactttgggaggccaaggcgggcggatcacaaagtcaggagatcgagaccatcctggctaacacggtgaaaccccgtctctactaaaaatactaaaattagctgggcgcggtggcaggcgcctgtaatcccagctacttgggaggctgaggcaggagaatcacttgtacccaggagggtggaggttgcagcgagctgagattgcggtactgcactccagcctgggtgacagagtcaaaaaaaaaaaaaaaaaaaaaaaaaccaccaaaaaaaacccattatcttctcttgcactaatcaatatttcttttaagccatacttcactacaaacttaataaaatatcgtttaattcacattgcttctcttgcccaagcacctaaaatagctatctattagcctgggcaacatggtaaaatacaacaattagccagatgtggtggcacactcctgtaattccagctactagggaagctgaggtgggaggattgcttgaactcaggaagcggaggttgcagtgagccgagattatgcctctgcactccagtctgggcgacagagcgagactctgtctcaaaaaaacaaaaacagacacacaaaaaagctccctattgatcacatatctggattttacaacctggcatcaaagatctgcataataatggcaatattagctaagatgtcaatagcacttactatgtaccagtatttctaccatctattgctgtgtggaaaaaaaaaacagccaaaacttagtggcttaaaaacaaccactgtatttttttattttaaattgattaaaataaatttatacccaggacatagcagaggactgcaggtgcctcctccagctctgtcccccaaaacaaccattttattacctctcactagtctatggattgactgatggttaagggaataggttctgaaatcagactaactctcaaggttatgattgtgaggattaaatcctcacgtgtgtatgtgaagtgtttagcatagtatctggtacctaggaagtgttcagtcaatgctgggcatcattattattatattttatgagttatttttcctaaactcaatgataataaatcacaagttcctcaaaggcagaggctaggtcttcgatgttgaggttcctcatttagactaccaaagggttcttaacacaagaaagagctgaataaatacttttgatttgaatcaacaggtgtgataaattaaaaataagtatccctcatttttcattaagcttttagaaccctaaacttacagacctgaaaaaaaggggccctaagttattttttggaggctagaatctccaagcactcccccacgccagcctggagagtactgtctttataaccagtgtctactggtgaagtatgacattaagctgtattagacatcatcagcatttacacagaagtgaatgacagactcttagggttctgagactcttgaatacttctggaatttttaagacactgatggcttcagccccagagattttgttttcaactaccctttgatggaggctttgcatctgttgtctttaaaagcactccaggtgattctaatgtgcagcagagttaagaatcatgggtccaggtcaaaggattagagcccatattgagcaataacagatctgaaatcaggagacctgggctcttgtattgaatactggatcatcaattcaattcaagaaactgtttttgtgaaatgctctatgctagataccataacatgaagaatgaggagccaataatctggacctttagtttttgagtctgatcatttaaagatgggagtggttttcctacttttaaaaaaaatgtggttttagcttttaaaaatgaaatcttacatataagttcaatatatgtaaaagaaacaaaaggaaagcaggttggcattaggaattcctactatactgcattagccttccccctgcttttctccattggaagctgactctaactgcattttcctcctacagttttggtggcgtactttctccttatcctaaggttgcaaatttcacttttcttggagcacaacggaagagaagtcaagcatttgccacagagctgtgggtgcacaaaatactcatgctgactagaaccttggctcagaagagtccctatctgctcaagtcttatgggaggcactgtagtttgtaccatttctgactttctgcttagactctcccatgtgttttctgggctaaattagtcactcttctccaattgttccaagtaatattctgggaaaggaaaacctaacaaaataacttaaatattcaatcatgtaaacacattctcaacatttcatggaaacaatctaaggcagtaaatccataaaccaaagaaagctttctgggacctagacattcaaatagtgtaattatggcctggcatggtggctcacgcctgtaatctcagcactttgggagactgaggcggacggatcacttgaggtcaggagttcgagactagcctggccaacatggtaaaaccctgtctctactaaaaatacaaaaattagctgagcgtggtggtaggcgcctataatcccagctactcaggaagctgaggcaggagaatcacttgaacccgggaggcggaggctgcagtgagctcagattgcaccactgcactctggcctgggggatagggtgaaacttttcctccaaaaaaaaaaaaaaaaaaaaaaaaaccccacccccccaaaaaaaacccagtgtaattacttcccattattgaacatgatgtcaatactcttcagtggctcatgacgaactcttcattgtattatttgaaaatttaaaaatattattaaaaacttaaatctatattgtctaatactttcttccaaccctcacgttgcccacgaacaaaactctttcaagtctaggtctgtatacttcacgatcttttcttcttcaagttttacaagacataagacagtgggtagaaacagcaataatcttactggttctgagaaaaatcacagtagacattaaagcttgctagttccttttttggtttagtggggacactttatattatattctatacatggtgatagcaaagtaagaagaggtatacttttggaagaaatctattttttttctggaagatgaaaaatttcaataaaaatttttacgtttttattaagttattctgttgtaaaaattttatttttaaatgtgtatgtcaggaattatttgatggtcctggaatcctcctgcaatagggtccaggatgattgtttccaaggcagaaacagaattgaaacagactcacacaggacaacctccgtagcgttgccccccaatcttctggcatgactttctaggagatgggatgcgttctcccttcagtacgatcttggccttcacctcctactgtctcagaattagaagagagggcattgttccttttgtcaaacacatggtccctttacctgtttgtgggaggtgttacaatcttctaaaaagaaaatgtacttggaggggccaacagaaataatcaaattccatgctactgtagaataaattagaggctggctcagtcataattatgtttcctttctcactgttttcttgcaaaataaatgatcaattgatttttaatggcactacataacctactaaagactgctcaaattagcaactttcttttaacttctattccaaagtagaaattctgcaacttcacctgatcttcacatgattctcctgtgctgtctcattctttagcttttcttcattttgttattccatagattttttttccatgtttctgacctctattcttttttttctcttcttccaacagagttctgtaatcatctctctgtagaagcctcttgtatttatatttgtagctggacttatctttcaagttaaaattctgcaattttccttgttttctggacagatccacatagaagtccaagctacgggtagcctgtagttctttggttttagttttattattaataattaggaaatctttaaaaagtggatttctgcctctttttttttgagacgaagtctcgctctggagtgcagtagcaccatcgtgttccttctgcctccatttccagtcacaattcccagtaagtgattcatgtgttttttttttgcctataatatttatgtcatctcatacttcacccactctttatctcattcccacctgcaagataaatgctcatttatcattcatgggcacacatgtcacaatttttgggggctgttcctccttgggtcaccaggaactaatgtattcttacagtacttagattgtatctgttttagaatacacatgctataatttgtttgactaatctatcttctctgtaagcgtgtgtatttaaggttggagattttgacttgttggcttttgtagtcctaatactcaggacgtggtagcataggacatcaatgtctactgaactgaactgtactatatttcttttggagtagacaaagaaatagtcttagtaggctgcctcatttttctgaagaatgaacaaaagggtccaaacctttttttcatcatataaaaaaaaattgtccatcacatgaaaaaagttaattatcattcaaaaaaagttgataagttcagaaaaatatttcataaaattaaaaattagtaattattataaaaataaatttaataagattaaaaatactgttaattattcactgaagaacacaataagtgttctagagcttctgagtaaattgccccagtttccttctatcactagtttaaatagtatatataaactaatcttaataaagaacattagttctaaactaattataataattcatagtttctcagaagcagaagtttttcaggagcagtaggatagaggaacagtttttcaaaactagaaaggaaaagtgggagaagccaggagaggttgtgctgaaagggaagaggaggaggaggaatgctaaactgtcttaaagaacaagaagaaaatgaagggaggaaataaaagcaagacactaattctctgaccattctaaaattctgctgtgctggaaagatgtgctgtaataaacacattcacatcttttccaggccaaatgtggattcagccagcactgatgcttgtcttcactctcaaacatttttctgctgactaatttatttttaagattaatatttggtttacagcagaaaaaaacgatgaaaaaaaacccttcatcacccactccctcccctatcttttttttttgtggtcaaaaatataatcccttgagacctattgtaggaaatgcgatgtatccagatcacgaagtctgaaaaaaaacaaaatccttttcctattttgtaaatttttgagacctcttatcatttaccaattaaaagtgatgacttaggaaatatctattttttatatttctataagatttttcttctagccacaatctcaatactatgaaagtcggcatatttgtattccatcagaattacctacaaactctcgtatctatagaaggacaatcaggatccatattaattactaaggcaaagccagtattcaaggaacttctgaattattagtgaaatacaaaagtgtatttagtgtaattttgaaaactatgttccctattagaaatacgtgaaaatggccaggcatggtggttcatacctataactccaacacttggggaagccaagggggaggatcacttgagcccaggagtttgagaccagcctgggcaatacagtgagatgtcatctctacaaaagaaaaaaatttttttaaattagctgtgtgtggtggtgcatgcttgcagtcctgctactgaggaggctgaggtgggaggattgcttaagcccaggaggtggaggttgcagtgagctgagatggcatcactgtactccagcttgggcaacagagctaaaaaccagtctcaaaaaaaaaaaagagaaatatatgaatatttgaaacttataaataatactatgtaacgattaaagggtaaaccataacaacttgactttgccccctctaagccaaaacttaatgaagtatccttgctggttatatgtgtgaaaatgcctgaagaaattagagggcaggagtgatgtcaactcagtatctctaagcaaaaagattaaaaaaaaagtttctagaggtatgcttcataaattggaactcatttgaagaactctattatagttaaagaacttgaggtttgaaatcagacagaattgagtgagtcctgttctgacatttactagctaggtagtatagattctttccaagccacatttccttcaccttaaaatggaataaaatttcactgggttagattaggtactgcaagtcaaacgtagcatcttgtatatagtaaaagttcagtaaatattagctctctttattattcctatcacctgcctctggactcccattctttactgtgttctgttaggtaaatgaacttacatgagaaacaccaggctttgacatgaaaaacacagattttactttactcatgttagggagtatcggctgggggaatacctagagtctgatggtggcaggaaggtcaccacttagctagctcaggaaatgctgtgactctctgcactttaatgtcaccaactgattaggtcagttagatttacacaaatgacacaagtgacttttctaactgcttctctgattaggtaagttagattcatacaaatgacacagattactttttccaggtagactttcctattaccctaccctgaatttacttgccatgggctttcatattttgaaatggaaataataactaggtctaaaaattttatttacagccagataaacctgtgggtctttacgtagaatgtataagccaaagttaaaattcagcaataaagaaattaaataactataaaatcaggtagaaatgtaaatttatatttctttaaactgaggagtcatgttgtacatctcacattttttcctaatatatttataagagaattagtttaattgtatattatatactgaattagacacattttgaaataatacaggttacctaagcactccaggtgtggaaaattcttaataattagcagtcttaacgaaatcttctaacaacatgggtgagcctcaaaacctttatgctcagtgagaaaagcaacacacaaaagaacatatattgtatgattccctttaaataaaatgtctagagaagacatatttatagagacagaaagcagattagtggttgcctggggatggggagcaactgagaatgggcataaggtttctttttggggtgacagaaatgttctacctatttatttatttatttctattttttatttttgagacggagtctcactttgtcacccaggctggagtgcaatggcgtaatctcggctaactgcaacctccacctcccaggttcaacagattcttctgtctcggcctcccaagtaactgggactacagaagtgtgccaccatgcccagctaatttttgtatttttagtagagatggaggtttcgctatgttggccaggctggacttgaactcctgacctcaggtgatccaactgcctcggcctcccgaagtgctgggattacaggcatgaaccatcactcctggcctatttatttatttatttatttacttacttatttttgtttttgagaaatgttctaaaattagactgtggtgatggttttaccactctgtaaaacactaaaattactaatacacacacttaagatgggtgaattttatgatatataaattatacttcaataatcttcttcaaacaaatcttttgaatggctagatactagaaaataaatttttaaatgttgaatggagaattttgaagaaaaaatatgtttctcctgagaatgagtgtctgaataacgctcttattctgaagtaagacctaactcaatcaataaaacttcctcaaatgccaactacatgtggaggatctttagaatctggaaaggcttcacttcaggatgattgcacttaaggtgaatagggtatttatttttcctcccagggtaaacacaggctataagggtaccaaaggagaaagtgttagctctcctgggagtcattttgagtatcaataaccaacagatgtgcctcaaagaagtaatgggacggctttgccatattttgacagattccaggaaaccctttggaataccctggttattaagaaccacaacagggtgaccctgaggtgcatgggtcactggagagaaggcattaagttaaaggtggcagccgggtgtggtggctcacacctgtaatcccagcactttgggaggtcgagacaggtggatcacctgaggtcaggagttcaagaccagcctggccaacgtggtgaatccccatctctacggtaaaaatgcaaaaattagccgggcgtggtggtgggcacctgtaatcccggctactcgggaggctgaggtgggagaatcgcttgaacccaggaggtagaggttgcagtgagctgagattgcaccactgcactccagcctgggcgaaaagagcaaaactccatctcaaaaaaaaaaaaaagttaaatggtggcttgtggtgaaggggccatgactttcactgttgctcactgctattgttgggaaggaataatacaaaagtatgctactgtggttctatttctgctctactgggttttactttattattttccttctaaaaaagtaacctttagacatgaacccctgctttacatattctcagtatacactctggctctgaatttaataaacataatctttaaatgcaaagggcataagtaaatcaatgagtagcccaatgttattattcatcaactttgaaacgattcctctactgtcaacagctgatcaatggatatgaaaggccattagtatgtgtcgtgagggtaagggattatgtgttactaatctgtgattactctgaaacagatataagcacagggcttggcatagctaataaattgaaatcgaaaatgaaagtaccatataaacaacaaacataagtataaaagattacattatttttcacagtaaaagtaatcctaagaatttaaacctggctgttaaggtaccaccttcaaagaaggcttccgtaagagttaatgaattacatgttacttagtaaaagtggaaagaagtaagaaggaactgtaggcttacaatccaggggaaaaaataatttgtggtggctgtcgcatgacaaattccaaaggatctaagacaggcgatgttacaagtgggaaaccttgaacactctgacactaaataaaactctaaaagataaacataacctttcatctgggctaatgaaatatcctgctcatatgagaatagtaggtacatatataccatcttttcattacaaatataaatggattaattaaaaataattaggtatatgtgctattatgagaggatgaccaagatgtaccactaagtgaaagaatcaaggtgtgaaaatagagtaaatggtttgtttttgttaaaaacgatacttttaaaaaaaattatttttatttttattttgagacatagtcttgctctgtcacccaggctggagtgcagtggcgtgatctcggctcactgcagcctctgcctcctgagttcaagtgattctccttccccagcctcctgagtagctgggactataggcacactccaccatggctggctgatttttgtatttttagtagagatggggtttcaccatgttggccaggctggtctcgaactcctggcctcaagtgatccaccaccaaaaaaaagaaaatttttatctgcatgtgctggcagtaatgcgtgactcttccctggcccctgaccctcattcccactccttttccccaggaaggaaaccaatggttcagaggaaatggggtgaaggtggaaaagggaacttttactttgcattttgttcctttctgtactatctggaaaatatatatatatatataattttttttttttagacggagttttgctcttgttgcccaggctggagtacaatggtgcgctctcggttcatggcaacctccgcctccaaggttcaagcaattctcctgccacagcctctcaagtagctgggattacaggcatacgccaccacgcccggctaatttcgtatttttagtagagatggggattctccatgttggtcaggctggtcttcaactcccaacctcaggtgatccgcccgcctcggcctcccaaagttttgggattacaggcatgagccaccgtacccggtatatacataacttttacttaagataatgtccatctggttggtggcattgtggaccagtttgatttttaaaaattatctgcagtattagactattaatataagttcctagggaccatgtcaatgttttattaatgttgctgcccagatgttgcctgttatagtagctttttatattgagatactcaataaacttttgttccactgaaaaaaattaataatgttatttaaagtattttaaaagtaagtttaaacaagacaagcagctgagtccattctctgaagcaatgctggcaagacccaggaatttatactggctggacagtatgaggatggctaatttgcaatttgtgcccaggaatatgtaatttacatctacttcctgaattaacaaatctaatatgcactagaaataattttccaaagggtaaagatttagaaaatatccgagaatccgtgtgatctaccttacctaacccctctgttatcaatgcagtacttctttcttccaaatctatccttctctgtcttgctttgtgatactggaactggcccttataaacatttctcctttgccaaaatgcagaatattaagctttgccagtaaaggtgctgaaggaacactgcagtagaaagtgtattctcttcctagttctggtgtactttctccttcttgctcctgtggtaagcacctaatggtggtgtgtgggaccacagtggcagtgctatctataaagtttcagtggtaccccaggtggtagcttcctatcaagtttcactagcaccctagaagtttcacggccatcctagtggggggcttcctagcaagtcttgccagcactccagcaggcagtttactgcttgccagttctggtctcttgaaattcgatgccatccagtggccacaacacctctccaacatgatctgaatcagcctagatctgggaaggggctctcttccaagtttgcttctttgttaggtagtatgcctgagccctagaggtagtagttgctccctatattttattcctgcattcttacgaattctctttacctcttagtagttaatcccctattactacttaataactccttatattaaaatttctggtcaggcgtggtggctcaccactgtaatcgcagcactttgtgaggccaaagtgggcagacagcttgagtctaggaatttgagaccagcctgggcaacatgatgaaactctgtctctacaaaaaaatacaaaaatcagccaggcgtggtggctcacccctgtaattgcagcactttgggaggccaaggtgggcagacagcttgagtctaggaattttagaccagcctgggcaacatggtgaaactctgtctctacaaaaaaatacaaaaaatctgctggacatggtggttcacacctgtaatcccagcactttgggaggccaaggcaggcggatcacaaggtcaggagatcaagaccattctggccaacacggtgaaaccctgtctctactaaaaacacaaaaattagctgggtgtggtggcacgtgcctgtagtcccacctactcgggaggctgaggcaggagaatcacttgaacctgggaggtggaggttgcagcgagctgaaatcgcgccactacactctagcctgggcgacagagcgagaccctgtcacaaaaaaagaaaaaaaaaattagctgggtgtggtggtgtgtgcctgtagttccagctacttgggaggctgagatgggaggatcacttgagcccaggaggcagaggctgtagggagctaagattgtgccactgcactacagcctgggcaacagagtgaaacactgcctcaaaaaaataaaaataggccaggcgcagtagctcatgcctgtaatcccagcactttgggaggccgaggcaggtggatcacctgaggtcaggagtttgagaccagcctgaccaacatggtgaaaccccatttctactaaaaatacaaaaactcagccaagtgtggtggtacatgcctataaccccagccacttgggcaactgaggcaggagaatcacttgaacatgggaggaggaggttgcaatgagccgagattgagccattgcactctagcctgggcaacaagagctaaaactctgtctcaataaataaataaataaaaataaaacaaaatttctctgttcaaattactggtgtggtttctggctcctgactagaccttgactgattcatccctaaaccaaaataacccaaaacaaactcatccaacaacaaaccatgccaaccacaaaaaatcaaatctaagcccaccactaaaacctatgtatgattaatctgctaacacagagaaacagtatggcagttaccaaacttgttaacttattgcttcctgaagctgactgtgcatgtagctgaatagtaagtcagctgctaccacagatttactgtttatgattgcatatttcagaaggatgtattaaatgcattgttctgagtgtgggtggttatctaattctttacaagtccttcacgggaaaagaaatttgctggttttttctgccataagaatgaatctatttatgaaaaagcatagatataactgtagtaagtgacagaattttaaaaaatcactgtgaacattccagaaagttctcagaaggttcgcagaaattaccagtaaagttaaactctaatttctggcttcaatgtcattcattcaataaatatttactgagtggccctgggacatagcagtaaagaggacagacaatattccagcctcatgaaatttactttctgtgatggggaaaaaacatgtaaacaaaccaatatgcaacataaattcaggtgttatgaagtactataaagaaaattaaggaaaaggatgtaacgggtgtgggtggtattttaggagatgatttagtgttctatattaaatttcctacacatagcatgcaataaatgttataataaatataaccgcagatatatcttaggcatgctactaagaggacaggattttcatgtagttccataataaatcaaactgaatacatttatgtaaatcataacaagcttatatatggaccaatgaaacttaccctatagaaagcactggtcaaagggagtaatgctgcggcaatgttgtattcttctaaacttgaacaatcctttaagcaaaacaaagacaaaagagcattaggatatttaccagaaatcacaaatacatgcgaactaacatctgggatacactgtttactgtcctatggggtttttacctttttattttgcagaggacctgacggaggggtttgtactcttattccaaattgccattaagacatagctaggtaagttttgggggaaaaaactgtgtgtgaagcacattcttttataaataaggtaaaagtatatttgagaaaggtattttcatacattattgctgagtagccacctttactttcctgctctacaaagattgttaaaagttgtgtaacttacacaaatttttttttggaggaagttttagtatattcagcaactgtattccattgagtctaagatacatttttttgcacattttaacatttctgagatggggatcatcttataattgactggagatatttttttctttcttattgttatataaaaagggttatctttcaggctgggcgcggtggctcatgcctgtaatcccagcactttgggaggctgaggcgggcagatcacctgaggtcaggagttcgagaccagcctggccaacatggtgaaaccctgtctctactaaaaatacaaaaagccaggcatggtggcgggcgcctgtaatcccagctacttgggaggctgaagcaggagaatcgcttgaacccgggaggtggaggttgcagtgagccaagatcccaccactgcactccagcctggacaacagaatgagactccgtctcaaaaaaaaaaaaaggggggtggggcggggaggatctttctattgatcagacaagatatatcactgattctaaaacccattgagtgaaatgctgatgaatagaaaggtcaggaaatctcagtgggaaggtaaaatggcacagtgactgtggaaaacagtatagcgattccacacatgcaaaaaataaatatagaattactgtatattacagttattcttcttctgggcatatacccaaaataatggaaaacaagaactcaaacaggtttttgtatactcatgttcacagaagcattattcacaataggcaaaaggtgaaagtgacccaggtgtctgttgacagataagtgaataaacacaatgcggtatacaagcacacacacatagatgcatagaatattcagccttaaaaagaaattctgacacatgctaccacatggacattatgttagataatttttttttttgagacagagtcttgctctgtcacccagggttggagtgcagtggtgtgatctcagctcacggtaacctcagtctcccaggttaaagcgattctcatgcttcagcctcccgagtagctgggattataggcacatgccaccacactcggctaatttttatatttttagtagagacggggtttaactcctgacctcaagtgatccgcctgtctcagcctcccaaagtgctgggatcacaggcatgaaccaccatgcccggcggatagatattttcatacagttatattaaccagtccttcctctgtctagcagtggggtccaatgtggccagaatccagaatagtgcccacaatggctgcaaaagctgcaattgattttcctagtgggtgaagaatagtgattaaagccctgaccttagacaatgtagctatctccatcaaaactcctcatccatccgttataagtttgcatgaaatgattttaaactcatagagctgggaccttagacatcaattattccagtgcaattcctccactttccagactagagaaaagaggcataggtgtcagccacagagccacaactggagtctggatttatctacctatcagtgtggtgttttttcctctagacactgccttttgtacttgctttcctttaatttttgaggtagaacatatggattgtctgaacttccagcactaattttagagtgtgagggtggtgagaactaacctgaccaggagagcagcagaaggcttagagctgcctaagtgcactagtgcccgggagaagcactccagaaaacaggaggaagagtcagaagggaaagtcagaagtgaggaagagtcagaagggaaataggcaaagataatctttgcctatttcaaactactgctgcggatggggagggcgtagtactgccctgaggaaaaaggaagaaactttctttcaagagcttagcctagaagtggccatctagtctaaagctagtctttctagcctgagtgcttttggtactaggatcagctaaaagagttttcaattgaatttcatgtattgtcaattctgaaaaacagtttagaatttactgcatgttctattgcaatgactactgaaacaataatggattataaggctgggcacggtggttcacacctgtaatcccagcactttaggaggcagaggcgggtggatcacctgagctcaggagttcaagaccagcctgggcaacatggtgaaaccctgtctttacaaaaaatacaaaaactagctgggcacagtggcctgtgcatgtagtcccagctactcaggaggctgaggcaggagaatcgcttgaacctgggaggcacaggttgcagtgaactcagatggtgccattgcactccagcctgggcaacggagtgagacctgtcttttaaaaaaaggattataagataaatctcagcagtaaaaagtcattctcatatggctcacattctgtgacccagttaaaaataaaaaagtaaaagataggctcaagcttcctatattatgctaaaaataatattttaactaattcatcctattgaataaacatttattggagaaatgaataagtgaataaataaaggaataaacataaggagaacaatgagaaaaaggggctaaggacagaaacttgggaaagatatgtatttatataaaggcagagaggaaaatcaagatggggaaggagaactggtgagaatggtatcacagatgttaagaggaaatgaccaacagtgttacatgctttagaggaagtttagtaaaataaagattaaaaaaaaaacaacaacaaaaacatgagaaactgatgaatataagaggtcactggtgatttctgaaattattagagaacaggtgagtagaataaaacaaaaggccctgactataaatcttcaaggttggaaaggagagcaataaaatagtcacttgggctgggtgtggtggttcatacttataatctgagcactttgggaagccaaggcaggaggactgcttgagcccaggagtttaagatcagcctgggcaatatagggtgactctgcttctacaaaaaattaaaaaaaaaaaaaaaactggccaggtatgatggtgcatgcatgtagtcccagctacttgggaggctgagatgggaggatcgcttgagcttgggagtttgaggctgcagcaaactatgatcatgccgtgacaccccagcctgggtgacacagagagacactgtcaaaaaaaaaaaaaagccacttgaagagttattacatctaaatttattgtttaatgaatctcaacagggctcaactagatgaacggtgagattttatccaatcctttgattcttgagaattagaagggtcccaagtacactaaaagggaaactccaatggaggagagagaggaaaaagaaagatcactagtagactgaggactctgagatacgtctggtagtcaatatggtccccatttctaaggcatggttagaccctgaaaacatcataaaaagcaaatatctagaatttatattaaacagcaagatccctgatgatatcatcagatataacatatgaggaaaaagcagcttggttctgcaaggaagactcaggacttcctatttttatggtgaggggaggatgagtggggagagctctttaaactattctgctaatactagctctgtagagtactgatagctgttacttggggggaattggggaaatgctgggtaaacaaaattaaacaaggttttccttttcttctttttttttttttttaaaaaaaaaaaacaggatttggcaggattttaaactgtgactccatgaagggaattcggtatacagcatttgtaaacccagtttcactgagtattttaaaagaaagcagttgtagaatatattttggaaaatgatgatttaagatcatcaaaaatcctatgaaagaattccaaccaaaatgttagatacgagttctaaatttcattttaaagaatcaatatgtcagtatgttcaattctttgccttctacttttaaacttaacttcctcataaagcaacctttttcgattactgctccaccctgactcattccagttaccagctccgccctgactcattccaattatgtgatacctgctccgccctgactcattctccaccctgcataaccatttttcccaccaaaccactcaccctgtcactctctttaaattagccaatcggaattagtttagcctgtgcggtctaaccctagccaataggggaaggacgcagcagcaggggccacgtgcgtcagggataagaaccccttcccttcccttgtccaagtgtgagctcaccattgctccatctgtaagggtgcacccttctatagaagtaacttgccttgctgagaaaaagacaattttatatttgagtgctatttcttttgcggcactgaaactttatttataacaaaaagatcatttaaaaaaattttttttaaatgttcttagacaggatcctgctctgttgcctaggctgtgcagtggcacaatcatagtttactgcagccctgaactcctgggctcaagcgatcctcctgcctcagccttccaagtagttgggactacaggcacgcatcaccgcacccagctaatttttaattttttttttgtagaggcagggtttcactatgttgtccaagctggtcttggactcctgcttccttctgcctccacctctcaaaatgctgggattacaggcataagccatgacacccagcccaaaagatcattttaaaatttacttatggatttttatttcttgacttatggttgttttcataatctgaaaggcaatttttctaaaaataattttaaatgatagataaaatattttaaaatctttaatacaatgcaataaattggcaagaaagcaaggaatatgcagaccaaaatataagtagaaacttggaaagataaacagagcactgaagctaaattttaacttaggaactggtggtgagcaaattttagtattagttgtgaactcaagagactcaagggataggacaaaaagactagcacttgctaaagggaggaagtccattagaagaatataaaccaaaaatgaaatcctgagccctacaaccaaatgaatagacccctggccaaagggatcccagcgaaacctgaaaaactgaattcctggccataacaggaagggaggtcagacacgccccattacgccctctcccttttggtgtttaggtaaaattacagatctgacaaaacagactctttgtggcaataagataccagattataaacacgacctaaggccatgcaaggcaggggttaagtcataccctataaaccataaaatctcattaaatgggttttttttaaatttttatattttgagacagggtctcactctggaggctggagtgctgtggtgcagtgtgcgctcactgcagctgcgacctcctgggctcaggtgatcctcccacctcagcctcctgaatagctgggaatacaggcatgtgctaccacgcccaggtaatttttgtattttttgtagagatggggtttcaccttactggccaggatggaatcaaactcctgaactcaagtgatcctcccacatttggcctcccaaagtgctgggatcataggcatgaaaacaggtttttaaaattatcccagcataaagcagcttcctttccaacctgattctgatacagcatcacatgatagatagaagaccctgaaggaaatcaaaatatttttctttgacatattgtgaaatggccctgcaaagtcatctgttgtgggagaaatctgcatctgtaaagaatctccattaatgcagccaggccttccctttctaggactttctcagctgtgggagagattagctgggagtctgacacttttatggtctaaaaagagacatgtaccatctattctctctgagggctactacctatgaggcttcatctacataataagggctttgacctccacaactcccttatcttgactcaagcatttctttctactctactgacatcaagtatttatacaaagcttaactctttcaatcagtagccaatcagaaaatctttgaatccacctatgacctgtaagccaccaccccacaagatatcccacctctttaggacgaaccaaggtacaccttccatgtattgatttatgattttacctacaatttctgtctccctagaatatataaaattaaactgcaacccaactaccgggctgtggtcactcctagtggctcagaataagcctctttaaaatattttacagatttgatttttcaattaacaagaatgacaataatcctgggatctctaaagccatctatgacaccagatagaaagtctgagatgtaagaagataactgagccaaaaaagagataaatatgtaggtaaatctaaacacacattgactgtataaaacaatgacaatactgtcttttgatagcaaagaaagttaagatacaactaaactatacaaccatggtagcatagactttctaagggagtggattggagttagattttgatagattttgataaattaagtaagcctttaagaatttctgtattatcatgaaagaaacagaaatagagtgggttgcaacttccaaactagtggaggaaaaaatggaataataggaaaataaaaaaaaaaaacaacaaacctgaacccaagggaaaacaaaaaagaagtggaaaaagaaactcagaaaagggaaacaattggccgtgcgcggtgactcacgcctgtaatcccagcactttgggaggctgaggcaggcggatcacgaggtcaggagatcaagaccatcctggctaacacagtgaaaccccgtctctactaaaaaatacaaaaaattagccaggtgtggtggcaggcatctgtagtcccagctactagggaggctgaggcaggagaagggcgtgaacccgggaggcagagcttgcagtgagccaagatcgtgccactgcacaccagcctgggcgacagagcaagattccgtctcaaaaaaaaagaaaaagaaaagggaaacaatcagaaaaagaaaaaaaataagatggtaggaataaatgtgttagtggtggcaaatatctgagtctcacagcaccaaatatgttaccagtcaaggtatccaaggtattactgatggtgaatccatatgcgtctgcagcaagctcaattcttgcctcctcagaagaaagaattggactgaggggcataaggcataaaaagagaccgaggcaagtttcagagcaggagtggaagtttattttaaaaagctttagaacgggaaagaaatgaaataatgcttggaagagacccaagcgggcacgtgaaggtcaagtgccattttaaccttgatcctaggactttatttatacgctggcccctttcccatgattcttcccttaggctgggctactcataagtgcagtgccctccttacacttgggaggtgagcatgcgcagtgtgtttaggaagttgtatgcacgcccatctgtggctttcttccctttttgggtggtgtgcccctgggaggtcatactctgccattttgtctcttaatgctcatgcccaggaagttgcttctccctggtgcctgcattcaattaacactttagtgtaccaggtgtggacaatcaggaaatggactctccctggtgccagctgccaatttatcacttttagagaggcaaagtgataactgcccaactatcacctgacattcctagagggtgggggacagctttctcctgccccgctcatgcctgtctaactacttgtaacaaatacaaatacaataacacaaatggaccaaatgttctggttaaaaaaacaaagattgacactgaatctaaaaacagaatctaaatatttgttgcttataaacaacatatatatatataaaacttaaggatacacgaaatttaaaggatgaaaaaatatgtaccaggcaaataccaaaagaagttggggtagctatattaataatcagaatataaaatactctttaaggcaaaatgcattactagggataaaatgaagcactacataataataaatagctcaatctaccagaaagctataacaatttaaatgtatataaacctaataacttagcctcaaagtatacaaagcaaaaactgacagatgtaaaaggaaaaacagataaatttacaatcatgctaaaatattttaatatacctctctcagtaactgatagttcaagcaggtagaaaaatcagtcatcatattgaagattaaaagaaatactgtaaacgttagagctaatagatatgtatagaacactgtatacaaaaacttgcttgctctaatggacactgcactttctaacactgtacccagaactgttcacatggatttaaaaaaattgacctcatactggtccataaaataagtatcagggctgggtatggtggctcacacctataatcacagaactttgggaggccgaggtgagaggattgcttgagctcaggagttcaagaccagcctgagtgatagtaagagctcatctctacaaattattaaaaattagttgggtgtggtgtcatgtgcctgtactcccagatacttgggaagcagagatgggagaatcacttgagccgagcaggtggaggctacagtgagccatgattgtatcacgtggccttccagcctgggtgacaaagcaagaccctgtctcaagaacaaaacaaaacaaaaaactatcagtaaatttcaaaatgttttgaatcatatagacagagttgtcagctcacaatgcaattaagttagaaatcattaatgcatgtaaaatacttaaaattgtacctggtacatagaaagtactcaataaatgttattatcactgaggctaggaaatgcttagcatatcacactctattgtgattatctatttacttgtatgtctcttcactagattataagcaatttaatggcatttttattaagaagcagttatcaatatttatggcaagttgttgaatgagtgatatgcctttttgaatgtcatacaaagctgaaagaacagtagaacaaatgatcttactaggtcttggatttccagaattaacattgagcgtaatcaggattttcctttgaataacgattttcatttactcaacaaatatttattgagtatctactatgtgccaggcatgctgtagctaatgaactcaggaatctctttatcccaggaggaaatagggatgacaaataagaacacattttaaagggatgagataaattcatggctgaataagatacatccttaaattagaggacaatgatgttcttttatgatgtctctgtggggacctttgttggagcccagttactggttagatagatttttaagtcagaacaagtaatcttttgttttaaattcaagaacatgagttttacatataaaaagagtgactgttaaaactcagtagcagctctccctcagtcaaacctctggaaatgaatgtgtgtgagaaaggagagggagaaaagaaatatgagtcaatgagaacttccttcaaagagaatattaaaatcaactaaaatattactttgaaggcagtcattaccttggagtcgtgtttaggtttttattttaaaatacagtcaggccatgtaggaaaacaccgcacctttttcctatgtggtatctctgcaaggtctccatcctctctatggattatatataataatcccagaatgcagcaaaaagtatgaatcatctttttcttcctgacttattcctcacccccttaggacactgctatgcacaagaatgtcatctgtgtcctagcacatctgaatttctttaacagaaatgccttgcatgtttctgaagactgtcatgaggcccaaggcaataaagttcaacagacttgagctgtaatcttctcccaaggaaatggttgggatgccaagatgccttttgactttgatttcacagcagggcttcatttgtaatgacactgtccaaactttaaatgacaacagctgtgatatgaagccctacacactcatttataataattttccacaaattaaaaaaattaaacaatggggaatttcaatccatgaccaattagcagggaacaggcaatcataaaacatttagactagtgggcactatttattatcttacaaaatgtttactcattgtagtgcatgtctcaaacctgtgtgctgctcaaatgctgattgcaaaatataaataaaaaattctttgcaaatcacgttagagacattctaagttaattaggttgaaagagggaaaaaatttacaacaataagtctacaactattgacacagcaaccgcattccagaattgtgtggttatctgttggggaatcagtccataaatacacaatctgaagtcccctgtgctttggccaaataatagcattgtagtaataaacataccagacattttataaacttgcaaggtcttgaatactgatacatgttttattctgaactttgctttgtaatttacctttaattttcctgctacaattgaagagtgagccctgcaatcttaatttcccattatcctcaattacttcgtacttttaacctagatacctttgaactgttgttgccaacattccagtttgataaaactctggaatctctaaaaaatgttatatttaaacattaaagaaaaaactagattgaaaggaacaatgtgttacagaactgactttcctttagagtttagattagacacagctcagaaaaaagtttttttgaattgcccaaaacactgaaaacatttgcatcttctacataaggacaaaaattaaaaacacaaattcctctctgtatcacattactctcctattcaaaaattcagctattttctgaccattatagaataatgaccaaactcttctgccaggcttattagcccttctcggtacggatccacctctctacccacccgaccatatgggcccctgccacaagctgctgctttagtcaacctattttatttatcaccttctattccacatcatacttactcctaccatatctaatacggttgaggaagcccatccatgctttggtttgtcatttacatgctttctccttggtattttcatatgcatgcccccatatttctcccttctttccaagtacaatgttaagcaaaaaataggcaaaaggatttttttattacagtttcagcttcaagttatattttaacattaaataaacctacaaaaccataaaggatgtaccacagttttgaataccactgttatttatatgcacaatgactcccattgcaatagaaggtgaatgctaggcttgacaaataatatcaagctttattttaagttatttgagtgaatggaccaagtcacttttaactttatatgcctggaaactagaacactgcacctggcatatggtaataattagttagcacttattaagtgtttactaagtatcacacatatttgaagtatgaatttacagatattatttcatttaatcttcacaacatctcgattagataggtactgtaattatgtcctttttgttgataatgaaactgagcctctcagaggttaaattatttgcttgcgattatatagccacaaatggcagagccagaatttgaacctggatagtcttactccagtatttgtgcttgaaacctcaacgttctcttgcctctcaagtaagatactgaactgaatataaaaatggagtctgtggaaacataattcatgaaaaagaaaccttctagtgaattataaataatatcctcaagagagtttgaaactatacatctatgaaaaagcaattaaaaacataattgttacaattaaaatgcaatggaagggcttgaagaaaatttttttcttatgtgttcattttatctctatatttaggaatttaaaaacattacaaaatatagaggatgaagttaaagcttctaaaatatacctaacaggagtactggaaattgtgaatagagaaggcagatggggggcttggtgcggtggctcacgcctgtaatcccagcactttgggaggccgaggcgggtagatcacgaggtcaggagatcgagaccatcctggctaacacggtgaaaccccgtctctactaaaaatgcaaaaaaaattagccaggcgtggtggcgggcgcctgtagtcccagctactcaggaggctgaggcaggagaatggcgtgaacccgggaggcggagcttgcagtgagccgagatcacgctactgcactccagcctaggcgacagagcgagactccgtctcaaaaaaaaaaagtcttatctttatttaaatttttggcccaaatgccatctgttcataatcttgttgttgctgttgttgttgttttagaaagggcagggtctcactctgtcccccaggctgaagtgcggtggtgtgattttggctcactgtagccttgacctcccgagttcaagcgatcctcccaagcagctgggactacaggcatgtgccactgcgcatggctaatttttttttttttttttgtaaagatgaggttccgccacgttgctcaggctggtcttgaactcctgagctcaagcgatcctctcacctcagcctcccaaagtgctgggattacagatgtgagccatcatacccagcctattctttactttgtattaaaattatgtatactgcatatcctccctaattagtcataaggccttttgagggcaatgattgtgttatacataatagatgttcagtgaatattactaaacaaaagaaagattactctaaaaatgaaaagaaagctattttacaaatacagctaaaagagaaaataaagtattagtatagtgattcctttttatgaaatcacttctcaaatgtgcagttttattctaaggaactcactttagcctaaccacttattttggaaggtttttgttttctattctgttggttttgtatttacccccatactttctctcttttttttttccttttgaccttagaaggaaggtaaaaaaaacctgacttacaatataagataccctgaggcggctgggcgcggtggcttacgcctgtaatcccagcactttgggaggccgaggcgggtggatcatgaggtcaggagatcgagaccatcctggctaacacagtgaaaccccacctctactaaaaatacaaaaattagccgggcgtggtggcgggcacctgtagtcccagctactcgggaggctgaggcaggagaatggcatgaacccgggaggtggagcttgcggtgagccgagattgcgccactgcactccagcctgggtgacagagcgagactctgtctcaaaaaaaaaaaaaaaaaagataccctgacgactttgtggtaaaaacactcaaatcttagtgagaagttaagttgtaaacatctgtagtctgtgggtttattttcagaagttaacctactgaaacctaaccttctatagctcagagtcttcaataactattggaatagtatctaggcctaggacttcccatcaaaaaatattgccattcctgacatgccattcctggcatggcagatcaaagaagaaatgatatatattttaatatatgatgctgaggctgttgggcagaaatatggaaaaataaaataaaattggactcttacttcaaactacatgcaaaatcagttccacgtgggtgaaggttagatggtaacataaaaaaatgtgttcatgacttcaggttaggggaacatttcttatgatacaaaaaagcacagtcaccgagaaaaagactaataaattcaactatagtcacgtggccttataatgatgttttggtcaatgatggactgcatatatgatggtggtcacatatgactataatggagctgaaaaattcttattgcctagtgacattttagccattgtaacatccaagagagcacagtgtaacacattactcagacatttgggctgatgttggtgtaaacaaacctactgtgctgccagtctcataaaaatatagcacatacaatttgtacagtacataatactgaatgataataaatgagtatgttactggcttatgtatttactacactatacttttaatcattattttagagtacacttctacttattaaaaaaaatagctaatggtaaaatagcccaaggcaagtccttcagtaggtattctagaaggcactgttatcacaggagatgacagctccatgtgtgttactgcccctgaagaacttccagtgagacaagatgtggtggtggaagacagtgatatggatgatcctgaccctgtgtaggtctaggctaatgtgtggatttgtgtcttcatttttaatgaacaagtttaaaaagtaaaaaaaaaacaacttttttttacttttttctacttttctattaaaaatagaaaacacagctggggctgggtacggtggctcacacctgtaatcccagcaccatgggaggccaaagcaggtggatcatgaggtcaggagattgagaccatttggccaacatggtgaaaacttgtctctactaaaatacaaaaaaaaaaaaaaaaaaattagctgggcatggtggtgcacgcctgtagtcccagctactcaggaggctgaggcaggggaattgcttgaacctgggaggaagaggttgcagtgagctgagatcgccccactgcactccagcctggtgacacagcaagactccatctcaaaaaaacaaaaaaaacaaaaaaaacacgactgggcacggtggctcatgcctgtaatcccagaactttgggaggccgagtcaggtggatcatgaggtcaggagttcaagaccagcctggccaagattggtgaaaccccgtctctactaaaaatacaaaaaattagtcgggtgtggtggtgggtgcctgtaatcccagctactcaggaggctgaggcggagaattacttgaacctgggaggtggaagtttcaaggaggcagaagtttcagtgagccaagatcatgccagtgcactccagcctaggtgacagagcgagactctgtctcaaaaaaaaaaaaaaattgaaaacacttataaagatataatgaaagaaaatatttttgtatggctatacaataccgtggcttttaagctaagtgttattacaaaagagtcaaatagtttaaaaaattaaaaattttgtaaagcaaaaaagttatagcaagctaagtttaatgtatttttgaagaaattaaaaaaataaattcagtgtagtctaaatgtaaagtgtttataaagtctacagtagcatacagtgatgtcctagaccttcacattcactcaccactcactgactcacccagaacaactttcagtcctgcaagctccattcacggtaattgtcctatacaggtgtaccattcttaatcttttatactgtatttttgctttaccatttctatgtgtagatatgtttagatatacaaatacttaccattgtgttacaactgcctacagtattcagtatagtaatgtgctgtacagatttgtaaccttggagcgataggctataccatataacctaggcgtggaatacgctaaccaagcttgtccaacacgcggcccacaggccacatgcagcccaggacagctttcaatgtgcccaacacaattcataaactttttaaaaacactataaattttttttgttattttttagctgggtgcggtggctcacgcctgtaatcccagcactttgggaggctaaggcaggcaaatcacaaggttaggagttcaagaccagcctggccaacatggtgaaaccccatctctactaaaaatacaaaaattagctgggcatagtggcgggtgcctgtaatctcagctactcgggaggctgaggcagaatagcttgaacctgggatgcggaggttgcagtgagccgagatcactccactgcactctataaattttttttgttattttttagctgggtgcggtggctcacgcctgtaattccagcactttggaaggctaaggcaggcgaatcacaaggtcaggagttcaagaccagcctggccaacatggtgaaaccccatctctactaaaaatacaaaaattagctgggtgtagtggcaggtgcctgtagtctcagctacttgggaggctgaggcagaatagcttgaacctgggatgcggaggttgcagtgagccgagatcactccactgcactccagcctgggcaaacatagcaagactccgtctcaaaagaaaaaaattctaatttttagctcattggctatttttagtgtattttatctgtggcccaccacaattcttcttccaatgtggcccagggaagccaaaagattggacattcctggtaccatctacagtacactcctacttattttaaaaaattagtttgcctaagtagacaacaacaaaattgtcaagctacacatttctcagcatgtatccccactgtcaatttaaaaatttataaaatggcatcatgaagagtcaaatgacaagtcactgcatattgcatacaagaagacatttgtaaaacatataactgttatccagactatataaagaattactataaaacattaagaacaaaagaggtaactcagaaaaagttgggtaaaaatgtaaacaggtacttcaaaaaagagaaaaccgtgctgggtgtggtggttcacacccgtaaccccattttgggaggctgacaggggttgatggcttgagcccaggagttcaagaccagcctgggcaacatggtgaaaccctgtttctatgaaaaatacaaaaattacctcggtgtggtggcatgtgcctgtagtctcagctattcaggaggttgaggtgggaggaccatttgagtggagattgcagtgggctgagatcgcgccactgcactccagcctgggcgacagggcgagactctgtctcaaacaaacaaacaaaatgagaaaactagaatgtccaagagacatgaaaaattgctcaacttcagtagtaaatgcaaattataatcacaaagagatagcattacacagccaccagattgggaaaaattaaaaaggctgacaagtgttgataaggatgtgaaacaataatggagtttcttgtgggaatgagactagtataattacttagaaaaaaacatttgacctcatttaataaagttgaacatatgcatatcctatgacctagcaattccattcctaggtatatattctaacacttatatacaagtgtactagaattgcatggcaatgatgttttttaacagagttgtttaaaatagctgagattaaaaaaataaaataaaataaaataaaataaaataaaataaaatagctgagatgtggaaaaaaccaaaatgtccacatgaataaaatgtaggagtgacagtccagaggtatgggctcaccagaaaactaagaccaaatcacagaactacagaacgcttctcttccctgacactttaccacaatacattagtaaaggcctacttacagcagctccttttggttgttgttgttgctgttgtttaagtagagacagggtctcactatgttgcccaggcaggtttctaattcctgggctcaagccatccacctgctctggactcccaaagtgctgcgattacaggcattatgagccaccacaccaggccttatagcagttccttttacatagtatatcacatttggctatcaagataaaattatgaggcatactaaaaggccaaaaacatagactgaagagacagcaagtatcagaaacagacttagatatggaggtatgttgaaattatcagaccaggaatttaaaacagctgtgattaatatgctaggggctccactggataaagtagacagcacacaagaatagacggacaatataagtagaaagatggaaattcctagaaagaaccaaaaagtaatgctagagatcaaaaacacagttaacagaaataaagaatgcctttgatgggcttagtggtagaccggtcatggctgaggaaagaatctctgagagccaagaaacagatctgcatagatacagtaaactgatctttgacaaaggagcaaaggcagtaggatggaagcaaaatagtcttttcaacaaatgatgctggcccaactggacatccaaatgcaaaagcagaacctggacagagactttacacacttcacaaaaaatatgtcaaaacggaccagataccttagtgtaaatgcaaaactataaaactcctagaaggttacacaggggaaaatacagacaaccttgggcttggcaataactttttggacacactatcaaaagcatgatccatgaaagaaataactgataagtgaggcttcacaaaaatcaaaattttctgttctgtgaaagataccatcaagagaatgaaaaaataagccacagattaagagaaaatattggcaaaatataaatctgtacaacaccaagaatgaaccctaatgtaaaatgcgcactttgggtcacaatgatgtgttaatgtaggttcaccaactgtaacaaatataccactatgttacagggtgtttatagtggggggggctatagatgtgcggggggcaggtggtatacagaaaatctctgtaacttttgctcactgttgctgtgaactaaaaactgttttaaaaaataaagtctattaaaaagaaaaagaatataaggcttcaaaaattaaaagacaagtggagaaggatgaacttgtgaagatggagatgaaatggccagagagacagaaggatatgctagaaatgtttcattatggaagccaaggaaagagagtacttgaaaaagaaggccgggtgcagtggctcacgcctgtaatcccagcactttgggaggccgaggcgggcagatcatgaggtcaagagattgagacggtcctggccaccatggtgaaaccctatctctactaaaaatacaaaaattagctgggcgtggtggcacgtgcctgtagtcccagatacttgggaggctgaggcaggagaattgcttgaacccgggaagtggagactgcagtaagccgagatcgcgccactgtactccagtctggtaacagagcaagagtccgtctcaaaaaaaaaaaaaaaaaaagaaattctagctgataaactgcttcctctaactttaaaacaaggaaaagatggacttacccatgaagagataacattaataatttgtacagtttacatagtttcaaagttgctactgtaattttttttgcttttctttcagaaaaaaaattaaagaccagacttaaggttcctgtgagaaaaaaggaaactgaattataaatctgtcatatttagaaaggttagtaggttgaccaaataaataaaatgtataaaaaaccattctgtacattagaaaaagcttcatatatataaaaaatgtcataagaaaccaaataggctgggcacggtggctcattcctgtaatcccagcactttgggaggccaaggtgggtggatcacctaaggtccaagagttcgagaccagcctgaccaatatggtgaaaccccatgtctactaaaaatacaaaaattagccaggtgtggtggtgtgcacctgtaaccccagctactctggaagctgagacaggagaatcgcttgaacctgggaggcggaggttgcagtgagccaagattgcaccactgtactccagcccaagtgacagagtgagattctgtctccaaaaacagacaaacaaaaaaaccaaatagtaatttttagcattttaaatctatgagctatcataatgttgcctttataatactagcaaagataaactaatcaaatacttatataatcaactatcacaaataactagggataattttctttatgacttatatcataaaaagatgataatagaagatcagagaaaagcttagctagctctcagtttcaagaaaaatatcctgaaatgttattgtcaatggtcaaaatcaaacactggcagaaaaattttaaattttaagaatgtaattgttcctgctgagcattattaatgaaaatgtttttgaaattcaaaatccagttgcacacaatgaatgaaatatatttatatctatatttcacatatttccctgtgcttcaatacatttttttcacactcggtgaaatgtgaagtgttacaggtggtcaggatagtaacatgaaagcggccttggaaatactaagaaacaatgtgcaagtcctgaacttacatctttttctttcttttccttttttttcttttttttgagacagggtcttgctctgttgcccaggctggagtgcagtggtgcagtcatggctcactgcaaccttgaactactgggctcaagtgatcctcctgctcagcctcctgagtagctgagattacacacatctggctaatttttaaattttttgtagggatggggtctcactacgttgtttaggctggtcttgaaattctggcctcaagtgatcctcttgcctcagcctcccaagtgctaagagtacaggagcaaattaccatgcctgaccctgaacttgtttcttaatgacaacataaaattggatactagtcagaagatcaacagcctcttgtttggcttgggccttctgtaacccccacccttatcaaccaaatggattatacttagacatttaatttaacctctgtaccatttaagattacacatgtgttcttttttttattttcatttaaaaaaaactcacaaacttccatttcaatatgaaagatctaggaaatacatgtaagtgaaaagaaagcaaaatatcttgtgataaatcctgccatctttgaatatcaatgtaacactttggtgtcaatacttcattttcttcctaattgcagatcatatatttatttatataatttatcttttataaagtcactttattcttgaactgatttccttccttggcctctgtgaccttcttttgtctcaggtcccattacaagtttttttgtttttgtttttgttttgagacagaatctccctctgtcacccaggctgaagtgcagtgacacggtcttggctccctgcaacctccgcctcccgagttcaagcaattctcctgcctcagcctccctagtagctgggattacaggcacacaccaccaggcccagctaatttttatatttttaccagagatggggtttcaccatgttgcccaggctggtcttgaactcctgagctcaagtgatccacccgcctcggcctcccaaagtgctgggattacaggcatgagccactgcgcccagccacaagtttttattattctatcttcccttcttaatattagtattcctcacttttttttttcatcttcagatctcttcttatggtacgtgccttcctgaggttagcgcgaccatttttgtaatataaagcaccactggaatctgtatcgccagcctagaccaccctcctcagctccatctgaccggacacctccaatttgatgtctttaaaaaccccaaacttgatatatcctgaactcaattatctgtacccaggcctccgacactcacccttaagcatgatcctcttccacactattttggtaaacaggaccagcatttattcagtcgcctagccaaaaacctttccatcacatcataccctacgattccatcacatatgaacttgatgcctgcaaagtgaccttctttctatctatccacccaacaatatgtttagttgaaataggcgcatctagggaccacgaattaagcagttatatgatcattgccctcttgaagcttaatcaagtactgttatttctatcttcgccacatttgtcatcggctccctcttactaacttactacctttggactctcaccatggctataacctttactcctatccatttttgagcctttgggggagctctgtagtacaaatcagattgcttctctgttttcccccccatcctcctatttttagctttcccatgtctactaagtctacttgtccattttctttttatttcttttttttgagacagggtctcactttatgatccaggctggagtgcagtggcacaatcatggctcactgcagccttgaacctcccaggctgaagccatcctcccacctcagcttcctgagtagctggaactacaggtgcacgccaccatgcctggctaatttttgtatttttgtattttatttatttttttgcagagacaaggttttgccatgttgcacagactggtctcaattcctgggctcatatgatccacacatcttggccttccaaagtgctgagattacatttatgagccactacgcctggcccctttgccttctgtcttctaaaatgttgtagctaatatctcttaatctattttcttttccttgtggatttacgtctttttttttttgagacggagtctcactctgtcacccaggctggagtgcagtggcgtgatctcggctcgctgcaagctctgcctcctgagttcacgccattctcctgcctcagcctcctgagtagctgggactacaggcgcctgccaccacgcccggctaattttttctatttttttttagtagagacgcggtttcaccgtgttagccaggatggtcttgatctcctgactttgtgatccgctcgccttggcctcccaaagtgctgggattacaggtgtgagccactgcatctggctttttttattttttaatcctctactatccaacttttaggaaaagagcagaagtaaatgtatggaggtaaattaccaggatcccagaattaggtcattcttcagttcgtaattcctagacatttctttataccactattgttagaatattttaatctcttttccctcacattctctagctgattttccatcaagatttgaaatagcctctcctttcttcttcttcttcttcttttttttttttgagatagagttttgctcttgttgcccaggctggagtgcaatggcaccatcttggcttgtagtaggacgagccacagacaaaactcctcagactccgagttaaagaaggaaggggtttattcggctgggggcatcggcaagactcctgtctcaaaagccgagctccccgagtgagcaatttctgtcccttttaagggctcacaactctaagggggtgtgcgtgagagggtcgtgatcgattgagcaagcagggggtacgtgactgggggctgcatgcaccggtaattaggtcgtaacaaaacaggatagggattttcacagtgcttttctatacaatgtctggaatctatagataacataaccaattaggtcaggggtccatctttaactaccaggtccagggtgtggccccgggctgtctgcttgtggatttcatttctgccttttagtttttactttttctttctttggaggcagaaattgggcataagacaatatgaggggtggtctcctcccttaggctcactacaacctccacctcccaggttcaagtaattctcctgcctcagcctctcaagaagctgagattacaggcatgtgccaccatgcccggctaattttgtatttttagtagagacaggggtttctccatgttggtcaggctggtctggaactcctgacctcaggtgatccgcctgcctgggcctcctaaagtgctgggattacaggtgtgagccaccatgcccggcctcttcttttttaaaaaaaacttacttatttcttatcttatatatacctctagtccaaagaaatagaaataagactcagtaagttgccaggtatactgggagagtacagcaactacatataactcataaggctcaaaactgcaaatactatatgtgtgtgtgtgtgtgtgtgtgtatatatatatatatacacacacatatatgtatatcatatatgtatatttatttacttatttttggcatggaaaaacaggcagaattgggaagggggaagaatttactctaagttgtataactgagctttggcagggagatagggaggcaagagtcaggccaagttcctgatacagagaagctaccagctttgtgtgtagtttatgagacctgatctagatattctaggcaccagtgcaagaagtatatactattaattaccacacatatggattagcatatgcctacataaaacctagtctgtctttcagaacatatacttaaaggaattttataattaggttgcagatcattagactctctgcttattgagttataaagtatcttctttcacatgtgagaagagacattaatctaaaatttctttatgattttatctaagatttcagtgctgtgtggaaaaagtagcccttcaaagtactggttttaaaatactagctgcagaaggaggccaatttcccgaaacaaaagtgagtggatattaaattgcaatgtggacaccatgccctgtaccgttatttcagaatgtccaggcacgaggacagtgataccctagtcagggaagcatgacatggagagagaccacgtctttctaatgccctggtgttctgtcagggttccacaacctacccttaagggttcctcctacccttaattttcccattcattgcatactttgccctacttctttctttctcttttccagtttacttctcttcccttctcagcctactgcctatagtaatagttttcaaaatgtggtccctggatgatatgcatcagtatgacctgaaaacttcttttttttttttttttttttttggagctggagttttgctcttgttgcccaggctggagtacaatggcttgatctcagctcactgcaacttccacctctcgggttcaagcgattctcctgcctcagcctcccaagtagatgggattacaggcatacgccaccatgcccggctaattttgtattttcagtagagatggggtttctccatgttggtcaggttggtctcctactcccgacctcaggttatccgcccgcctgggcctcccaaagtgctgggattacgggcttcagccaccgcgtccagccagaacttgttaaatatacaaattcctgggctccatcctagtttctacttaatcagaaactctgggtgtggccacagcgacctgtgttttaacatgctgtctagttattctaatgctcgctaaactttgagaatcactgccttatagtgtactaaaattatcctttctgatatggccttgaaacattctaaaaaactagaattatacctgattttggatacaagcaatgtgtgaaattctttgcatgattaaaattactctatttgcttaaagtaaattgtcgccacatttttaagattaaaatctaagtgttttaaggaaatatgcttgtgttacttacttcatacttatgtctttatttcttcaccagtaagtatgagcccagtgcatacaaagtaaaaacttgcatacagtctcttacaattggagttattctgtcttcaaagggcttacaagctattgcaactaacagataagcaggcttacctatagctaatataaatccatgtgtttaacttgccacaacagaagaaaaagatgttatgggattatagaagagggagtgattccaatagcaatcagaaaagccttcacgggctgggcatggtagttcatgtctgtaatcctagtactttaggaggccaaggtgggaggactgcttgagcccaggcgttttaagaccagcctgggcaacatagtgggactccgattgtacaaaaaacttaaaaattaactggcatggtggtgcgcacctgcagtcctagctactcaggaggctgaggtgggaggactggttgagcccaggagatggaggctgcatgcagtgagccacgatcatgacacggtactccagcctgggaaacagagcaagactctgtctcaaaaaaagaaaaaggaaaaaaagaaaaaagaaaaaaatcagcatccacgagtgaggcatattttagctggactggaagatgaatagtctatttggactcatttttctttcacattttcctctaatttttttctcttatatgccagtacttaatggctgttattttgcacatagtttaaactatgactataatttaaataagacttttacacatatctgcaataaaaatggggtctactgcttttcatttttaagcattatgttttgcctaaatagaagtttacaaaattaaactagtttatcattatttatgtgaattcaaaacttttttttatttcacacaaatttaaagaaatgttattatggttatagaccaaacaccattatcatttaaagaccatctgtagtgtactgaaaaaagcacaggacctgctttgaaacatacccttgtaactgagcacccccatttttctgagacagagagaatgagctcgtttttttctcttttctctatttccccctctttccacttcttacttagccctttagaaatgcaattataaccttttacctccctgttaccagatactccctacagagcaagttcatttaactatgtgcttagaagctccagagtggaacttgcacccaccaggaggttgcctcgagagacaacagtcaatctacaacccaaagtatgcccactaggaaactttctcctacctggagagtttcagctacctttataacctagttctgcctacaaaggcacagtgctcgccagcttgaatgctgggcagacagagtactgaagcaagtcatgtggatcccctcctctttcttcctccctcgcatgccattcctgccaaactcccttttaaaagcactcacttcctgctccaaaagtgaagcggtacccttaaggcaggaagcctgtacttcttccccaaactagctttggaataaaaaatcattttctttatactagatctctcccttgttaattggactctgcaagtgacgagcaactaaacctgcattttggttacaccctagttaaaaacaacaacaacaacaacaacaacaaaacagacaaggcgtgctgagttctacaatggagagactaagcaatttaaatccagtggcagaatttttggctacagtgagacaaactttagggacaaatgatactctacaaaaatgtggttagaatggtttcagtctaaatgtaattcttagaaacatcacggccactgtttactacatttgtgaaattttgaatctgtcaagagttgtttgagtaagcaaccttaaagaatgaaaagctatttacaatgggacatattttcttgactctaaaacaaaaaatggttgtagatcttcaccattttctaggcaggctcctcctggcacatggagatcatgctgtgaattgcaggaggaagggtttagcagtaaactttggaatgtaaccccttattggcaaagtatctgtacctaattgattttctttacccttttaaaaaaagaatctctagttcccggccccaaatggccacctaaacttcaatcaaatattgcaataaaatccaaactaagaggatttcactgaagtataaagtgtgaggcagaaaattagagaccagatttattagcttgggttgaatttcatgctagttccattaattaaaaagcaatttttgctaaatctctgtaagggctttgatgctctcaactgttctcacttacatccaccactacttcaggggcttctatcatcaggatcaaaggaaaatgagtggtggaaaaggaaagcaagactagtgtcttaagctagagtttgagcatgggattctagagcaatgatgtctgactgaaatacagatggtcctagacttatgatggtttgacttacaattttttgagtttaagatgatgtgaaagtgatatgcattcggtagggactatacctcgagtacccacacaatcattctattttccacttttagtatagtattcaataaattacatgagatatttgacactttattataaaataggctttgtattagatgattctgcccaactgtaggctaacgtaagtgttctgagcatgtttaaagtatgctaggctaagctatgttgttcagtaggctaggtgtattgaaagcattttcttatttatttatttatttatttttgagacagagtctcgctctgttgcccaggcttgagtgcaatggcgtgatctccgctcacggcaacctctgcctcctgggttcaagcaattctcctgcctcagcttcccgagtagctgggattacaggcatgcaccaccccgccccgctaatttttgtatttttagtagagacgaggtttcacgatgctggccaagctggtctcaaactcctgacctcaggcgatccacccccctcagcctcccaaagtgctgggattacaggcgtgagccaccacgcccagtcgcattttcttatttttatttatttattgattgattgagacaggctcttgctctgtcactcatgctggaatgaagtggcatgatcacagctcactgcagcctccaccttccaggctcaggcaatcctcccacctcagcctcctaagtagctgggaccacaggtgtacaccatcatgtccagctattttttttatgttttgcagagatgaggtctcactatgttgcccaggctggtcttgaactcctgggctcaagcagttctccctcctcagcctctcaaagtgttggaattacaggcgtgagccaccgcacctggcctaactgcactttcaacttaggatatttttaacttacaaagagtttatcaggaatgtaaccccattttaagtcaagcaggatctgtatgatgtgagctatatgtgtaatttaatattttctggtagcctaatttaaaatagtaaaaggaaacaggtaaaattaaatatattttatctaaccaaacacatctaaaatatgatagttcaacctaaaattaatgtaaaagtcactaatgatatatatatatatatatttttagatggagttttgctcttggagtgcaatggtgcgtgatcttggctcactgcaacctccacctcccggcttcaagcgattttcctgcctcagcctcccaagtagctgggattacaggcatgcgccaccacgcccgactaattttgaatttttaatagagacagagtttctccatgttggtcaggctggtctcaaactccaacctcaggtgatccgcccacctgggcctcccaaagcgctgggattataggcgtgagccaccgtgcccgtccactaatgagatattttatattcctttactggactaagtcctcaaaagccaatgtatatgtcacactaacagcacatcttggtttgaattagacacatttcacctagtcgaatctagttccacatgtgtcacataaagattttggactacattagactacaatacccttaaaatataggtcttatagtcctaaagttatagaaagtgtgattttctatctcttttcttcccacaattgccctttccttaggcttttggctgctatttttagaatactgtttagaaaattatggcaggggacatcaaatcagggtactgaacttgttatagggcaactgaaaaatgtcagtctccccaggctaaaaaataaggtttggaaccaacgtgataacgttttccatgaaattagttatagataaaagagagaacagtttgaacttcaaagggtatcaaagtcagacagcctcaaagactgatatgtggatctttcccctttgattttgttatgaaactgggctgtctccattgcagactatctgtaatctggcttaagttgtacttataaaagtgttttagtctccttgtttttttcccttttcacattgaactttggtcatttctacactgcataagtagaaaaatatttcgggtagactgtatttgattttcctgtagctgttagaaacttgcaaacctttttgtcactggtgagaattcaaaattgaagtttagccttaagaataaaaaaaattgtctttttttttttccttttaacaaactaccattggaaagactgaaaatcttaagtagggaaaaagcaaaaggatggcccctacttaaaatttcataatgctataccaatcaaaattcttatattagaacacacattcttttcaagtgcataaggaatagctgccaatatagaccatatactggaccataaaacatctcccaatgaatttaaaagcatgttatctgaacatgatagaagttagaaagcattaagagaaaaacctctgaaagatccacgcaaagagtataatataaactacataacataattctaaataacctaagcgttcaaagaagaaatcaaaagggaaatgagaaagtatttaaaaatgaataaaaatgaagacatattatataaaaatttgttggctgctaataaggcggtatttagtgagaaatttctagcactaaatacctgtgttagaaaagaagaaaggtttcaaatcaatcacattagcatctaccttaagaaaatggacaaagagctaattaaatataaagtaagtagaagaaaggaaataaaatgtcgtgtagaaatcaataatagacaacataaaaacaacagagagaaaatcaatgaaacccgaaactggttctctgagaaatttaataaaatgtataactctctagcttgactgaacaggataaaaaggggagacaacacatttttgccatgaggaatgagagagatgacattattctagattctatagatattaaaaagataataaagaactaggattaacatgttatatctatatattggacaattttgacaaaatgaacaaattccttttaagataccaattgctaaatacctcttacaaaataaataacccaaatacattacatctacaaaataattgaacttgaagttaaaaaccttctcataaagaaagatctaggcctggatatctttatttatgaattccaccaaatatttaaggaagcaataataccaattctagacaaactctactggaaaattgagccggagtatgcacttcccaactgattttatgaggccagcaataccctgctaccaaaaccagacacagaaattagcaaatcaaatccgacaagttaaaccggatgcagtactatgtgcctatagttccagctatttgggaggctgaagcaagaggatcactggagtcagtctgggcaagatagcaagtcctctgtctctaataaaataaaaaattaaataaaaaaataaaaaatacatcatgatcaactagaatggaaagctggtttcacattagcaaatcaaccaatgtaattcaccctgttaaaaaactgaagagaaaaactatctgatcaccttaaaagatacggaaaaaaaatctgacaaaataccacatcaattatttgattcctcagtatcctaggaatcaaaggacactttcataaacagataagagagtatctacaaaaaaaccctacagctaatgtctgcacttaaatctatactatttttcacaaaagtgcaaagccaattcagtgagtaaacaaatgatgcaacaacaactctatatctgtttgtaaaagaaatgaacttggtcccataccttataccaaattaaaaagataaactagaaacagctgagatctaaatatgaaacctaaacatttagcatttttaaagaaaatgagagaaaatttttgtcactttgggtttagagaagacttcttagatatgataccaagtgcatatctattcatgaataaaaaattgataaactggactttatcaaaataaaaagcttctgatctttaaaagacactgttcagagaataaaaatataagacaatatctgaaaataactgaaaatcatatatttgagaaggacttgtattcagaatataaaaatttttccaaactcggtaataagaaaacaaacaacccaatttaaaaagggcaaaatatttgaacatacatcaacaaagatatatagatggtaaataagtataaatcaagatgtccaatatcatcagtcattaggaaagtgcaaattaaaaccacatgagatacaaccacacacctattaggatggcttcaaatggaaagactgactacaggaagtgttggagaggatgtggaaatactggaactctcatatactcatggtgggaatgtaaaatgatagagctgcttgaaacacagcttggacatttcttaaaaagttaaaagtacacatactatagggtccagccaatacactcctgttattttaaactagataaatgaatgcattatgtccatcaaagacttatgcatgaatgttgagagcagttttacttgtaccaggccccagctggaaatgaatcaaatattcattaacatgtgaatggataagcaaaagtaactgaggtatttgcattgttggaatctgccgtttgatactggaatacgttcttaaataaatgtggttatgttttatacatcattttaatgggcatttctcactttatttttcttttgttaatgacttattacttgctgttcatttcatgttttagactatgaaaatgatgttagataaaaattaaattcaagcaattttcttgttcgagttcaaaacgggtcataaagcagcagagataacttgcaacatcaacaatgcatttggcccaggaactgctaatgaacatacagtgcagtgcttgttcaagaagttttgcaaaggagaagaggaagatgaggagtgtagtgaccagccattagaagttgacaacaaccaagtgggagcaatcatcaaagctcatccttttacaactacacgagaaggtgccgaagagctcaccattgaccattctatggtcatttggcatttgaagcaaactggaaaggtgaaaaagctcgataagtggatgcctcatgagctgaaccaaaaaaaacaaaaaacaaaaaaaaaaaaaccatcgttttgaagtgtcatcttctcttactctatgcaacaaggaaacatttctcaattggattgtgatgtgccacaaaaagtggattttatatgacaaccagtgacaaccagctcaggggtaggaccaagaagcagctccaaagcgcttcccaaagccaaacttgcaaccaaaaaaggtcatggtcactgtttggtggtctgctgccagtctgatccactacagctttctgaatcctggcgaaaccattacatctcagaagtatagttggcaaatcgatgagataaaccgaaaactgcaaggcctgcagctggcattggtcaacagaaagggcccaattcttctccatgacaatgcatgtcacacaaccaatgcttcaaaagttgaacaaattgggctacaaagtgctgcctcatccaccgtatgcacccaacccctggtcaactgactaccacttcaagcatctcaacaactttttgcagggaaaatgcttccacaaccagcaggatgcagaaaatgctttccaagagttcgttgaatcttgaagcacagacatttatgctacaggaataaagaaacttattattaactggcaaaaatgtgttgattgtaacggttcctattctgattaataaagatgtgttttcattgttcagctcccatggacacaggtaggggaacaatacttactggggcctgttgggggatggtgggggtgggagagcattacggaaaagagctgatgcatgctgggcttaatacctaggtgatgggttgacaggtgcagcaaacaaccatggcacacgtttacctatgtaacaaacctgcacatcctggacatgtacctcagaaattaatataaagaattttaaaaaaagtacaaacaggtgaaaaaaaatgtgtttgagcctagttataatgatttaaaattcatggtccaaaactgcatttacttttttaccaacctaatatttatacaatatataacagtactattcaccattaaaaaggaatgatctattgatgcatactacatacatcaaaataatgatgctgagtaaaagaagccagaccaaaaaaattacatatttgattccattcacataaaatgtagaaaatgcaacctaatctatagtggcagagaaaagatcagcagtcacctgggaatgggtatagaggcagggtgttgagaagaggggagagtatcctttgtatcccttttcttgtacaaaagagtacaagaaacttttggggataataaattggttcattattttgattgttgtgatagtttcaaaggtgtctatacatgttaaaaagttattaacttggggagatccgtttcaagatggctgaacaggaacagctctggtctgcagctcccagcgtgatcgatgcagaagacgggtgatttctgcatttccaagtgaggtacctgtttcatctcattgggactggttggacagtgggtgcagcccacggagggtgagccgaagcagcgtggggtgtcacctcacctgcgaagagcaagagattgggggatttccctttcccagcaaagggaagccatgacagactgcacctggaaaaacgggacactcccacccaaatactgcacttttaccaaggtcttagcaactggcagacaagaagattctctcccatgccaggcttggctggtcccatgtccacagagccttgctcactgcaagctagcacagcagtctgagattgaactttgaggtggcagcctggctgggggaggggcatctgccattgctgcagcttgcgtaggtaaacaaagaaaccaggaagctcgaactgggcggagcccactgcagctcagcaaggcctactgcctctatggactccacctctgtgggcagggcatagctgaacaaaacgcagcagacagcttctgcagacttagaagtccctgtctgacagctctgaagagagcagtggttcttccagaatggcggctgagctctgagaatggacagactgcctcctcaagtgggtccctgacccctgtgtagtctaactgggagacacctcccagtagggatcgacagacacctgatatagatgggtgcccctctgggacgaagctttcagaggaaggatcaggcagcagtatttgctgttctgcaatatttgctgttctgcagcctccactggtgatactcaggcaaacagggtctggagtggacctccagcaaactccaacacacctgcagctgagggacctgactgttaaaaggaaaactaaacaacagaaaggaatagcaccaacatcaacaaaaaggacatctacaccaaaaccccatctgtagttcaccaacatcaaagacaaaaggtagataaaaccacaaagatggggagaaaccagagcagaaaagctgaaaattctaaaaaccagagcacctcttctcctccaaaggatcgcagctcctccccagcaatggaacaaagctggatggagaatgactttgatgagttgacagaagtaggcttcagaaggtcagtaataacaaacttctccaagctaaaggagcatgttcaaacccatcgcaaggaagctaaaaacttgaaaaaaggttagacgaatggctaactagaacaaacagtatagagaaaaccttaaatgacctgatggagctgaaaaccatggcacgagaacttcgtgacgcatgcacaagcttcaatacccaattcgatcaactggaagaaagggtatcagtgattgaagatcacattaatgaaataaagtgagaagacaaggttagagaaaaaagagtaaaaagcaacaaacgaagcctccaagaaatacgggactaggtgaaaagaccaaatctacatttgataggtgtacctgaaagtgatggggaaaatggaaccaagttggaaaacactcttcaggatatcatccaggagaacttccccaacctagcaaggcaggccaacattcaaattcaggaaatacagagaacaccacaaagatactcctcgagaagagcaaccccaagacacagaattgtcagattcatcaaggttgaaatgaaggaaaaaatgttacgggcagccagagagaaaggtcaggttacccacaaagggaagcccatcagactaacagtggatctctcggcagaaaccctacaagccggaagagagagggggccaatattcatccttcttaaagaaaataattttcaacccagaatttcatatccagccaaactaagcttcataaatgaaggagaaataaaatcctttacagacaagcaaatgctgagagattttgtcaccaccaggcctgccttacaagagctcctgaaggaagcataaacatggaaaggaacaaccagtaccagccactgcaaaaacatgtcaaattgtaaagaccatcaatgttacaaagaaactgcatcaattaatgggcaaaataaccagctagcatcataatgataggatcaaattcacacataacaatattaaccttaaatttaaatgggctaaatgccccaattaaaagatacagactggcaaattgaataaagagtcaagacccatcggtgtgctctattcaggagacccatctcacatgaagagacacacataggctcaaaataaagggatggagggagatctaccaagcaaacgaaaagcaaaaaaaaaaaaaaaaaaaaaaaaaaaaaacaggtgttgcaatcctcaatcctagtctctgataaaacagactttaaaccaacaaagatcaaaagagacaaagaaggccattacataatggtaaacagatcaattcaacaagaagagctaactatcctaaatatagatgcacccaatacaggagcacccagattcataaagcaagtcctgagagacctacaaagagacttagactcctacacaataataatgggagacttcaacaccccactgtctatattacacagatcaacgagacagaaggttaacaaggatatccaggacttgaactcagctctggaccaagtggacctaatggacatctacagaactctccaccccaaatcaacagaatatacattcttctcagcaccacatcacacttattccaaaattgaccacataattggaagtaaagcatgcctcagcaaatgtaaaagaacagaaatcacaacaaactgtgtctcagaccacagtgcaatcaaattagaactcaagattaagaaactcactcaaaaccgctcaactacatggaaactgaacaaagtgctcctgaatgactactgggtacataacgaaatgaaggcagaaataaagatgttttttgaaactaatgagaccaaagacacaacgtatcagaatctctggggcgcatttaaagcagtgtgtagagggaaatttacagcactaaatgcccacaagagaaagcagggaagatccaaaatcagcatcctaacatcacaatcaaaagaactaaagaagcaagagcaaacaaattcaaaagctagcagaaggcaagaaataactaagatcagagcagaactgaaagagatagagacacaaaaaacctttcaaaaaaatcaatgaatccaggggctggttttttgaaaagatcaacaaaattgatagactgctagcaagactaataaagaagaaaagagagaagaatcaaacagatgcaataaaaaaatgctactcgggaggctgaggtaggagaatggcatgaacctgggaggcggagcttgcagtgagctgagattgtgccatggcactctagcctgggtgacagagcgagactgtctcaaaaataaataaataaaaataaaacataaaaaatgataaaggggatatcaccaccgatcccacagaaatacaaactaccatcagagaatactataaacacctctgctcaaataaactagaaaatctagaagaaatggataaattcctggacacatacaccctcccaagactaaacctggaagaagttgaatctctgaatagaccagtaacaggctctgaaattgaggcaataatagcctaccaacaacaaaaaaagtccagaagcagacggattcacaaccgaattctaccagaggtacaaagaggagctggtaccattccttctgaaactcttccaatcaatagaaaaagagggaatcctccctaactcattttatgaggccaacatcatcctgataccaaagcctggcaaagacacaacagaaaaagagaattttagatcaatatccctgatgaacatcaatgtgaaaatcctcaataaaataatggcaaaccgaatccagcagcacatcaaaaagcttatccaccacgatcaagtcggcttcatccctggggtgcaaggctggttcaacatacgcaaatcaataaatgtaatctatcacataaacagaaccaacaacaaaaagacatgattatctcaacagatgcagaaaaggcctttgacaaaattcaacagcccttcatgctaaaaactctcgataaacaaggtattgacggaacgtacctcaaaataataagagctatttatgacaaacccacagccaatatcatactgaatgggcaaaaactggaagcattccctttgaaaactggcacaagacaaggatgccctttctcacaactgctattcaacttaatgttggaagttctcaccagggcagtcagggaagagaaagaaataaaaggtattaaattaggaaaagaggaagtgaaattgtccctgtttgcagatgacatgattgtatatttagaaaaccccatcgtctcagcccaaaatctccttaagctgataagcagcttcagcagtgtctcaggatacaaaatcgatgcgcaaaaatcacaagcattcttacaccaataacagacaaacggagagccaaatcatgagtgaactcccattcacaattgctactaagagaataaaatacctaggaatccaacttacaagggatgtgaaggacctcttcaagaggaactagaaaccattgctcaacgaaataaaagaggacacaaagaaatggaagaacattccatgctcatggataggaagaaccaataccgtgaaaatggccatactgcccaaggtaatttatatattcaatgccatccccatcaagctaccaataactttcttcacagaatttgaaaaaaactactttaaagttcatatggaaccaaaaaaggagcccacattgccaagataattctaaacaaaaagaagaaagctggaggcatcatggtacctgacttcaaactatactacaaggctacagtaaccaaaacagcatggtactggtatcaaaacagatatatagaccaatggaacagaacagaggcctcagaaatatcaccacacatctacaaccatctgatctttgacaaacctgacaaaaacaacagatggggaaaggattccctatttaataaatggtgctgggaaaactgactagccatatgtagaaagctgaaactggatcacttccttacaccttatatagaaattaattcaagatggattaaagacttaaatgttagacctaaaaccataaaaaccctagaagaaaacctaggcaataccattcaggacacaggcattggtaaggacttcatgactaaaacaccaaaagcaatggcaacaaaaccaaaatagacaaatgggatctaattaaactaaagagctactgcacagcaaaagaaactaccatcagagtgaataggcaatctacagaatgggagaaaaattttgcaatctacccatctgacaaagggctaatatccagaatctacaaagaactcaaacaaatttacaagaaaaaaacaactccatcaaaaagtgggtgaagtatatcaacagacacttctcaaaagaagacgtttatgcagccaacagacttatgaaagaatgctcatcatcattggtcatcagagaaacgcaaatcaaaaccacaatgagataccatctcacaccagttagaatggtgatctttaaaaagtcaggaaacaacagatgctggagcggatgtggagaaataggaatgcttttacactgttggtgggactgtaaatgagttcaaccattgtggaagacagggtggcaattcctcaaggatctagaactggaaatagcatttcacccagcaatcccattactgggtatatacccaaaggattataaatcatgctactataaagacacatgcacatgtatgtttattgcagcactattcacaatagcaaagacttggaaccaacccaaatgtccatcaatgatagactggattaagaaaatgtggcacatatacaccatggaatactatgcagccataaaaaaggatgagttcatgtcctatgcagggatatggatgaggctggaaaccatcttctcagcaaactatcacaaagacagaaaaccaaacactgcatgttctcactcataggtgggaattgaacaatgagaacatttggacacagggcagggaacatcacacactggggcctgtcaggggtgggggtctggggtagggatagcattaggagaaatacctaatgtaaatgacaagttcatagttgcagcaaaccaacatggcacatgagagcaagaactcctttactcccttgaggattaactcagttaagaaagagtggcattaatcactgtcaatgacctaatcatctcttaaaggtcccacctcccaacaccaacacatcaggggccaaatttctaacacatgaattctgaggaacatactcaaagtataggaagggccaacatctgaatagtataaatcccagaagagcaaaatgagaaaaagaaggaagattaaagaaaattgcccagaatttaaggacaaaagcttccagattaaaagggtttgacacatattcagcacaatatatgcaaataccccaatgacatcagcggacatcactataacatttctgaagactggggtcaaagggaagatcctacaagcttccacagagaaaagataaagttttgtgggaagcataaaggaatgcaatcatggatcaatgaaaaaaatttatcaatttcatctattaaatcaggacactaaggaagagaaaaacattataataagtgctgaaaagcaattgaaaaatatttatcagccaatacaaataacaagcaaaatgggaacagaagaaaactagttcaagataataaaaattatttactaaagccaaataaaaaataattatcctaaataacaaaacactaaccatttttattaggattaagacagtgataatttttatcagatttttatttaacattgtcttggaggttctggagaatacaatatgacaagaagatgaaataaataaattgtataaaaacgggcaaaaaagatataaaactttcttttgaattggtattattgcatgtctagaaaacccaagaaactaataaaaaactgaaattaataagagaattcggtaaaatggataggtattaaataagtatgtaaaagcaatagttttgatttattatagcaaaaaagcaactgaaaatggaaacagaaaaatacttcactcacaatatcagtataaactataacatgctaaagaatacatctaataaaccaaaaaacttgtaagaaaaccttaaaagctactgaaaggcacacaaaaaattgaaaactggatgttattagatgggaagacttataagaaaatattaaattttcagggtcgggcacggtagctcacacttgtaatcccagcactttgggggccaaggcgggcggatcacgcggtcaggagatcgagaccatcctggttaacacagtgaaaccccgtctccactaaaaatacaaaaaattagccgggcgtggtggcgggcgcctctagtcccagctactcaagaggctgtggcaggagaatggtgagaacccggcaggtggagcttgcagtgagctgagatccagccactgcactccagcctgggcgacacagcgagactccgtctcagaaaaaaaaaagaaaaaaaaaagataatattaaatttccaaaattaacatataaatggaatgcaattccaaatggtttgcactctcaattccagtggatttttttttcggggaactgaacagtattgtcttaatgtttatattaaataatcaatgcccaggaatggcttaaaaagtacaaaaaaaaaaaatcaatgtaggataatttgcttttggaacataatgtccttttatcaaataaatatggtattcgtttagaaataaatatccatggattagaataacaatccagaaataaatcccagtatgtataaaaatccaatacatgacaaatattatagttcaatttagtaggaaaatgacaaattatttaataaattttgccagaataactggccattctttcagaagaaaataaaactggatatttctaatatactgtatagttataaattccagctgcaataagaatcttgcaagaaaatttagacaacatatatatcttgatgaagaaaatgttctaaacagactgaaaatatagaggttattaaaaaaaaggctagccaaaatgagcaaatataattaaaagtttttctatggcaaaagttaaaacacaaagtcaacagataaataatgtatttgggaaaaaattgtaaagggcaatatctaaactaaagtgctcttacaaaatgtcaagaaaaagttaacccaaaagaaaaaaaggcaaaaagtatacataagcaagtcaaagaaaaatagaaaagccaaacaagcatgctttatttctttattttattttattttatttattttattttactttttgagacagagtctcactgtcgcctaggctggagtgcagtggtgcgatctcggctcactgcaacctctgcctccaaggttcaagcgagtctcctgcctcagccttccaagtagctgggattacaggcacctgccaccacgcccggctaatttttttctattttaagtagagacggggtttcaccaccttggccaggctggtgttgatctccggaccttgtgatccgcccaccttagcctcccaaagtgctggtattacaggcgtgagccactgcgcccggcctaaacatgcatttaaaataatgctcaaattcaattaatactgcagggactacaaattgaagtaacaataacataagttagttgactgattcctgcatccattcactcaacaaatatttactgaaacttttcatgggtgaggccctatttcaggtgctggggatcagaagcaaaccaaacaagttctttatatgtacttttaccaccttttttgcccatataacaaacaacatttacaagagcaactgaatctgttgttggtaaggatatgggaaaggagatactctgaaaaactgctggtggagatatgaaacatagccctttggacagcaacctgccaatacttattaactacaggtatcagtaaataaagacgtatatacaaggatgtttgttgaaattttgttcaaaggggaaaaaagctggcctgcaccatgaaatattaagtaataattaaaaagaatgtctgaaagcctcgctcctaaactgtggagtaagtcatcctaggtgctatgtggaaatgtcaagagtgatgtcatatatttttaattttcaggggaaacacagcatttttgaatgtatattgacactgaatctcttgatattatatgcttgaagtaattcggtttcaacattagatcatgccacattactattaatgatattgtgtctttgcaaagctgggtattgagtggttgctgtgattaaaaagtacacactatgctaaggccgggcgcggtggctcacgcctgtaatcccagcactttggaaggctgaggcaggcggatcacgaggtcaagagatcgagaccatcctggctaacacggtgaaaccccgtctgtactaaaaatacaaaaaaaattagccgggcatggtggcgggcacctgtagtcccagctacttgggaggctgaggcaggagaatggtgtgaacctgggaggcggagcttgcagtgagccaagatcgcgccactgcactccagcctgggcaacacagcgagactctgcctcaaaaaaaaattttttttaaagtacatactatgctaaaagatagaaatggtggtggtgcagccagtctaataccaaagtctgagcagctgtgtagtacccaacaggagcacgtataccattagtaagcagttgtagttatttttaaatgaaataaaaatattactatttttgaaaaaatttaagtgtatattttttcccaaatagctattaagttgtaggaatataatacacattacttggcctgaaagatttactaaatgaagctgtcaggtatttggtttggcccagggggcaccaagaaaatattgctgagatactaaggactcattgtgaactcagaaaatttgggaacctcttaaacctgcagcccaagaagtaaaaaataatagaacaagtgaaaaacttagatgaatggaaataataaagatagaaaagaaattaattagacagaaagcaaagatacaaaggcaaagagtttatagactaataaaatggacaaaactaattttaaaaaagaaaaaagccactaatcagtagacatgttcttaggaaataattaccaaaatgaactcaagaaaagctgaaaacctgaagagactataattagaaattaaaaatattctcccaaaggctggatgtggtggctcatgcctgtaatcccagcactttgggaggccaaggtgggagagttgcttgagagttcaaaaccagcctgagcaataaagcgagaccctgtctctacaaaaaaataaaaaaataaattagctgtgcatggtggcgcatgcctgtggtcccagctacacaggagagtgaggtgggaggatcacttgagcccataagtttgaggctgcagtaagctatgattcccacccctgcgtgccagccccagcctgggcaatggagcaagaccctgtctcttcagtaaaaataaaaaaaaaaaaattatcccaaagaaaacattaggttaaggtggctttactggtgagttttaacaaactttcaaggaacacacgatttcactctaacataaagtgtttcagagaagagatacagaggaatactccctatttcattttttgacgttagtataacttagctccaataccagccaaggagtatttgagaaattataaactgatttcaatcataaaaataattgcacattaagaatgagatagagctgtacaaaaagcatttcataaaactgacacctattatgacaaaaactcttaaaccaggaatggaaatggacttaataacctgatagcaaatatctaccaaaacttctagcacagataaagcttaatgattaaactttaaaagaaaggcacttactgtcacttctatttaatgttatactataggtccttgccagaaaataagaaagaaaaaaaatatatatataacgtttagaaagtgaggtaaaaaccattcctattactggatgatatgattgccaacatagaaaacagaaaagaatatgtggcaaattactaaaattaaggaagtttgcaatattaatagataagtttactgtatttctatatattttaaaaaaagcaattagaaaatgcaattttaaaagacagcatttacagtaacaacaacaaaacagggcacctaacaataaatttaacaaaatatgtatgagaccttcatggagaaaaatcatacatgtattttttgaggcagggtctcgtactgtcacctgggctggagtgcggtggcacaatcacggctcactgcaccctcgagtgggctcaagtgattctcccatctcagcctctcatgtagctggggctacaggtgtgtgctaccatggctggctgatttttgtattttttgtgagacagggtttcgccatgttgtccaagctgggctcaagcaatcttcctgcctaggcctcccaaggtgctgggactacaggcatgagctactgtgcccagcccatacagtgttatgaaagacattaaagatctagatgtacaatactatgtttatagatacgaaaacttgcaaaatgtcaattcttcctacattaatctatggattcaatgtaatcttaatttaagttccagtagaggctctcatggaagtgaataaggttattctaaaatgatatggaaacacaaggggaaagaatacagaagacatttcttaggaagatacagcatgggggcttgccctggtagatattaaaatttattataaaactttaattaagactatgtgatgggcaacatggtaaaatcctgtctctactaaaaatacaaaaaattagccaggcatggtggcgtgcacctgtagacccagctaccagggaggttgaggtgagaggatcacctgagcccaggaggcagaggctacagtgagccatggtcacatcactgcactgaagcctgggcgacagagtaagagagtaagaccctgtctcaaaaaaaacaaagaaagaaaggaagaaaggaagaaagaaagaaaagaaaagaaagagagagagagaaagaaagaaagaaagaaagaaagaaagaaagaaagaaggaaggaacgaaggaaggaaagaaggaaaaagaaagaggaagaaagaaagaaagaaagaaagaaagaaagagaaagaaagattgtgatgctcttacataaataggcgaatgaactgaatagaaatcctgaatggagtcacatatttatagaaatctgatatataaaaaaggggttattgcaaatcagtggtgaaaagacacagtatgaaataaattcttctggggcaattggttattcatttgcaaaaaattaactggatctctacctcacacaattcacaaaaatcaatttcagatagattaaggacttaaataggaaaggtaaaataactaaacattttaagagagtatgagaatatttttatggcctcatgatagtgaaggatttcttacacaagacacaaaaagtgtcaaaacatcaaggaaatgattaacgaagttgatgacattaaaattacaaacatatttgccaaaagacatcagaaagacagagaaaagacaaccacaaactaggaagaaataccagctgcatgtataagtatcaaaggactggtattcagaacatactaaaaactcccataaatcaatgagaaaaaaaagaaacaatgcgaaagaaaaaagggcaaaagaagcaaaaggcatttccttacacagaaaacatgcaaagccaatgaacatgaaaaattgttccacttattagtcatcagggaaatgcaaatgataattacaatgatatgtccttttataatcactggactggtagaatttaagaattcagaatttttaatactaaaagttggcaaggatgtgaggcaatagaaactctcatatattgctgtcagagtataaatttgtaataccattttggaaaataatttgttataatctaacacagctgaagttgcacatactcttgactctgatttcattcctatgtatttatccaagagaagctcttgcacaagtgcatcaggagacatctattaggaatggtcattacaacactgtgtttagttacaacaccgttttcattgccagggcaatgaaatatccttcaatagcagaatgggcttaaacatcagtgaaaataaataagccgtaactacatgaagcaacatgtatgaatatcataagctgctgctcaatgaatacttattttatcagtgaataaacaggatgattccaatcacaagaaggtcaaaatcaggcaaaactaaactgaattatattttaagagtacatccttattgggtaaaactgtaggaaaaagcaaagaaatgattaaaccaaattcaggacagtggttctaaaggagaggaagagtgaaagcagttgcagtatagctctgaaggacttcaatgttcatgttctatttcttaaactgggtggtgggcacacagatatattttactattgttctttaaacataacatatattaataaatactacagatttcatttcacaggtcatacaatgactactagaaaacaataccaagttgagatgcagaatgggtagtgattagcaaggtttacacactcgtgtttgactagcaaaaacacacattactacatattatggatattttcaaatagtcaaacacatataatatcaaattttcacaaaagagtgaaatacctaggaatacagataacctgggaggtgaaaaaatctctgcagtgagaattaccaaatactgctcaaagaaatcagagatgacacaaataaatggaaaaaacagtccatgttcaaggattcgaagaatcaataccattaaaatggccatactgcccagcaatttacaggttcaatgctattcctatcaaactaccaatgttatttttcacagaattagaaaaaatgaccctagaattcatgtggtgccaggagtgggagctcatgcctgtaatcccaccattttgggaggctgatgcaggaggaatgcttgaggccaagagtttgagaccaacttgggcaacaaagtgagaccctgtctctacaaaaaataaaaaattagccaagtgtggtggcacatgcttgtggttccagttacatgggaggctgaagcaggaggatcacttgagcccaggaggttgaggatgcagtgggccatgattgcaccactgcactccagcctgagtgacagagccaagattctatctcaaaaaaataaaattcatatgggaccaaaaaaaaggccaaacatccaaagcaaacaaagccggaggcatcacactacctaacttcaaactataccacaaaactatggtaaccaaaatcaggatggcactggtacaaaaacagacacataggccaatgagacaggttagagaacccagaaataaagccacacatctacaaccatctgatcttcaataaagtcaagagtaagaagcaatgaagaaaggacttcctattcaataaacggtgctaggataactggctagccatttgcagaatattgaaactggaccccttcctttcactatatacaaaaataaactcaaaatggattggtgacttaaatgtaagacctaaaactataaaaaccctagaagaaaatctaggaaataccattctggacacaagccttggcagaagtttcatggtgaattctccaaaagcaggtgcaacaaaataaaaaatagacaagtgggatctaaataaacagctttggcacagcaaaagaaactatctaaagagtaaacagacaacctaaagaatgggaaaaaatattaacaaactatgcatctgacaaaggtctaatattgagaatctaaaagagacttaaaccaacaagcaaacccaaataataaaaaatgggcaaaggacatgaacagacacttctcaaaagaagacatatacatggccaacaagtatataaaaaatgttcaacatcactaatcattagagaaatgcaaatcaaaaccacaatgagataccatctcacacgagtcagagtggactattattaaaaagttaaaaaaaaaacagatgttggtgaggttgtggagaaaagggaatgcttatactttgctggtgggaatgtaaattagctcagccacagtagaaagcagtaagagatttctcaaagaacttaaaacagaaccaccattcaacccagcaattccatttctaggtatatacccaaaggaatataaatcgttctaccaaaaagacaagtatacctgtatgttcattgcagcactattcacaacagcaaagacatggaatcaactgagatgcccatcaatggttgactggataaagaaaatgtggtacacatacaccatggaatactaagcagccatacaaaaatgaaatcacgtcctttgtaacaacatggatggagctggaggccattatcatacaaaatctagcaacacacaagttaaccacataacaagtctgcacatgcaccccctgaacctgaaataaaaattggggaaaaaaatgccaaatctacaactgctgacaggctattatatttctttttttctttctttctttcttttttttttttttgagatggagtttcacttttgtcgcccaggctggagtgcagtggtgcgatctcggctcatggcaaactctgcctcccaggttcaagtgattctcctgcttcagcctcccgagtagctgggattacaggcatgcgccaccatgcctggctaattttgtatttttaataaagatggagtttctccatgttggtaaggctggtctcgaactccggacctcaggtaatccgcccgcctcggcctcccagagtactgggattacaggcttgagccactgcacctggcctatgtttctattaacaaacacttatatatgtataacaaacacttaatacaatttgatataactaggtaagatactattttaaattctacttgcaaaagcaattatccagaatatttggaaattactgtgagtcttttctatacacttagacagatataactgggataagtataataaagacttgcagaaaataaagagtattacttaaggaatttcctaacctgtaacaaaagttgttttaggagaaatgaaacttaaggactggaatctagaattagttatttgatctaattagattgaaaagcattaataagttttttgccagcggttaatgagaaactggtagtccatggcatgcaatggcaaaacaattaattaaataaattatcacctatggacaactataatcaagtgcctatagataaccaaatagttactgccataaaatattttagttcaaataagaacaatggggttagtccattgttttaaagtgtgctagagaatttggagaaagatcacaatgagctcaggctttagattcctatcacgagtttcaggtaagggaacagaaaaatgtctatgaccgctctaaaagataaatcaagtaagatatagcagctgcagtgctgagatgtctaaatataatatacaaagtctaatcttttagctgactcagctaacaagacacactgagttcacaacctcacaggtcttttaggttaaattagatgctgatggggaagaagggtgtggtgactatatactgtcaatttagctaagctggtactacattacctctagttcctttctctgtatggtgctgttagtgtcactttgtgattggaaggtggaagtgaagcggcatctatgcttatgctcagaggtcaatgtagggtcaggtactcttgcagcttgctcatactgtcactaaccaaaaagatgctcaacaccactcccgttagggagatgcaaatcaaaaccacaatgtgatatccggttcacatacattaggatggctactattaaaaaaaaaaatcaagcgttggtgaggatatggagaaactgaaacccttgtgctggtgggaatgtaaaatgatgcagctactacgcaagacagtataacagttcctcaaaaaattaaaaggataattaccataagatccagcaattctacttttggctgtatactcagaataactgaaagcaggagcttgaagagatgtttgcatactcatgttcatagcagcattatttacaataagcaaaaggtgacagcaacccaaagtgtccactgacagatgaacgggtaaacaaaacatggtatatacatacaatggaatattatttagccttaaaaaggaaggaaattccgacacatgctacaatattatgttaaatcagcaagtcacaaaagaacaaatactgtatgatttcatttatattaagtacttagggtagccaaattcatagacacacaaggtagcatggtggttgccaggagctgggggcagggggaaacgggagttatcgtttaatagataggaagtttcagtttgggaagatggaaaaagttatggagatgtatggtggtgacatttgcacaacaatataaatatacgtaatgccactaagctgtatacttaaggatggttaaaatagtaagtttaatgttatatatatttaaccacagtttttaaaaatccaactagagttcattgattctttaagtacttctgtactttctgaaataaaaagatgttcaagcccttcttatattttccttgccctactcctgctgctagccatttcttcaagaattcttagttccttttagtagactcatatttagaaaccaagatctggacactagacatgctcattgctatagggtgtctctgttgccagactctctcagaacagagccaggaaatatatgtatgcattcctaactcctcccctcatatacacatagacgtatacccacatttccaactgttattttagtatttataaaaagataagcatcattagcttaaattcatccaaaaccatatgattcattctagctttctccttttccatatttgtactcacttctatatctgtgaaaaacttggctaccattaccctcaatagatttacttatttgctttgtcttctgaggataaacaatatcctgacttcactaggccacctatactacctcatttaaactcaatgtttataagcataaggcccagcttctatttggctgccattacttctctccctgagcctgtttaatggtgcctggacaaggaaagaaagaaggaaagaagggagggaaggagaaaggaaaggcaagagaaaagaagaaggaatgggaggggggagaagaaaggtagaaagcacaatttctaaaaaattttactttttagttgttttttgctgatgaaaataaatgctattgatttttataggctaatcttatatttgaaaacctaactgagtcatcttattagtaaaaatagtttgttctcatacattttctaggtagaggatcagaaatctgattttctatctaaaaataatgacagctactgacacactaataacattgttaatagtgtaatagtaagcatctttgtcttgctctaattttaaaggaatgcatataaagtttcttcattaactacaagggttgctgtaggttttaccaaacatggaagctcttttctaataacagcttctaagaacttttaaataaatagcattaaactttattaaatgccttttcttaactgactgagataatcataattcttttcctttaatctattaatggggtgcattacactgaaagaatcctaggttaaactccactatattatgacgctttacttttttaatgcactactggattagattagccaatatttttcttaagagttctgcatttacattcataagaaaaaggggcttttttttcctttctttatattgtatctatctgattttggaatcagagttactcgagattcacgttttattaaaaacataatgctgactgacaaaagacaaaaacaatgaaatacataatacaccatttacataaattaaaatacacatgtagtaaacaatatacatttttcaaggacacctgcatagaaaataatatattgaacacattaaaatatccacaatgtatacatacttcaaaacatcatgttgcacatgataaatatacaactttatctgtcaattaaaaaagcacatttaaatgcttgagggagattgggagcataatgctgataaaaataaacaaataaataaaataaggaagggaccttgcagggaccaaagatgatactgtgttatgaactggagaaccaggaatgcttctcgtaagcagggattaaaaaaaaaaaagtgtcctgagatcatgaaattcagaggaggagacactttagagggcatttagtccaatctccctgacaatgtagaaatcctttacagctttcctgacaaatgactataagagtgtttgatggcacactgtatgagatgaggatggcatttctacaaagctgcccatttcactgttgaaaagtttcaaatgttagctctgatctccccccttcccaaacttaacaaatcagaacatctgatgatggggctcagaaatgaacatgaaaaagttttaaaatgactactgcagataataggacactgatatttcaactctaggtatatatcaaatttacttgtgggacattaaaaaatacagatgtgtaagcttcagctatgatgattgtaactcagcagtatgaacatttgcactttaaatatatcgatgacactcctgtccactggcacaatattgaccagctgtatgtaaactttaagtttactttcaagctaggtcatgaattatcaacatgtccgtcaacattctctaacctagagattactgtgcacaaagacataaaggtgaatagagcttggctcgggttgatgattagattatagccaagaaaggggcaaaagctactggcctgtgaagggacagaaactcagtatagggactaaaattctaaccagctgaagtaagcagctacttacaacacattcatttattcatttattaattcatcaaatttttagtgagagactactccatgccagacaaaatgggaaatatacatgtcaacaggcaatatcattatatgtggttaagtgctactgcaggatcatggtggatagtataggggaagtacaagatgaagtagaggcacagagttgctaccaatccaggcttcatgggctgaggaaggcttccagaaagaaatgacatccaagctgaaattaaaggatgagtaggagttggccaagggaaaggaaagattgagggagcagggaggagaaaggaaaggaggaagaaacagtgttccaaacaaaggcaatagatgtgtaaggcctggggactgacagcagtgaacgatgagactgtagatataggcaggggccaagataagatcagaatttactatgaaggcaaaggattttaaattgtgaagtgaaaagatacaacttgaaatatacgagtatcactttggggaaatggagaacagttatattatagaaatgggtcaggatggaggtagggtaaccagttaagaagttggtgcggtagcagaatttaggagatgaatttaggcttgagatttggaaggcagaagcaagagatggtaatgcagatgagtaagactgcctagggagaattttagactgagagaagatctaaagatggatctaaagaggcaaatgaaaataccagattttcatttagaattcattgctttaatttactagttgtgtgatttcaaaaatgtacttaatttctttaagtctatttccagagggcaaccatgattgtggcttacccagtttcacggacaaataaaagctgagattatctgaggcagtacagagtgatacaggcacccaagaaggaagaggacaggacaattataagtgctgactggatggttcttttacaagaaaaaatggaaaatgaaagcagactgggggaacaatggtggggagcagcaaatgactttgtttgatggtcccttctgtttaggtcattccctgaaaggagaagtaaatcaaagaatgacagaagaaaataatgtccacatggatgaagcttgttgagtgacagcttcattatagtatgccctgggagagctgttctactgaaaaacgtcaacctccacatctttaataaagtatttttctctttggctggtcacatttctcagagaacagttttacaatctcttgcctggaaggcaggctgccagagtcctggaagctaaagggggaaagcccactggcattctcaatatttggcattcacacaacctccttgtttgcagcaagacagaatttccctcaaccagacctagtatcttccaggccaatgacagcctctctctcataaaaataaatacacaaacaaacaaacaaacaaacaaacaaacaaacatctaatcttctgccatggtaaaggagaggcagctggctgtttacaccgaattaagaaaggaactgggagggggatccaacagaatcttaagcagctttcaaccaatcctctattttttatgttttagcctcaccttgtccttctgctcgcagagatacctgatgttactaattcctgagccttttggggttttgtaaactgggctgcctcaaggcttttcccgctgctacttgggaaaaggctttctcgggtctgctaagtaaagatcactcatctatcagctttctagcttctaagatgttgctgttgcctcctctcctgttctgcctgtgggtttatgtatttttttaagtggcttacttttgttttaatgggcttttgggtggtagcagagattaatgtacatatgcaatctgcttactttaaccacaggttactccatctactgttctcatctcttctccaaccacatttctacactatactcactaatatggaaatattcctcagttttcaaaatcacaggctctttcctgcatatcaaaaccacaatatgataccaccctattcctgcaagaatggccataatcaaaaaataatatatattggtgtggatgcggtgaacagggaacacttctacactgctggtgggaatgtaaaccagtacaaccactgtggaaaacagtgtggagattccttcaagaagtagaagtagaactaccatttgatccagcaatgtatctacccagaggaaaagaagtcataccaaaaagattcctgcacatgaatgtttctagcagcacaatttgcaattgcaaaaatgcggagccaacccaaatgcccatcaatcaatgagtggataaagaaactgtggcatattgggttgggcacagtggcttatgcctgtaatcccagcactttgggaggctgagacaggtggatcacaaggtcaggagttcaagaccagcctggccaagatggtgaaactccatctctactaaaaatacaaaaattggccaggcgtggtggcatgcgcctgtaatcccagctactcgggaggctgaggcagagaattgcttaaacctgggaggcagaggttgcagtgagccgagatcacgccactgcattccagcccgggtgacagagtgagactcaaaaaaaacgaaaaagaaaaaaaagaaactgtggcagatatatatgatggaatactactcagccataaaaaggaactgaattaatggcattcgcagcaacctggatgagattggagactattattctaagtaaataaggattactttattctttttccaatgttccagcttgacgcaaaactttcaggttcaaccagatggccaagacttatagaggccaagggtgtactcacaaatctgattgtcccaactgttaactgctcagggcttggttttctctacttgtccttttcttcagagtataaagaggtatacattagagattttcttttcttcttaggagaaacaatgtaccaaaataatggtttatatttgtttgtaattttctgagatctatttctatgttagtgagaaggttcctcatcgtatatgcaatttaacataatgctggacatagaagacttcactgggttttaaaattataatttatttttaaaagatcttagctaggatgtagacacataaaaagctttaattgtatatttgacaaaataaaaagttaaggccatgatatttttggagagatttttagtaatctcagtttcaaaaaatactaaaatatgatcagttctttgaaatgaaatgataggtaggaatagtctataacctctatgaaacagtgctataaaaaattacactggcattgaaataacctgataaacagccttttggcagtactcatgttccatttaattttcccttgtggataggaaagacagaagaataacttctaggtcatgaaaagtaaaaattaccaaagtttttgaatcactacctaaaaattagttcatttagttaatgtttctttcttaaaacatcaacacagatgtttggccactctgccttgaaactctatgcttttgtaaaaaaatgttcagaatgtcatgttaaatccctgttgataagtacgttgttgcatcaagaatataaatactaacaaatcccaagtgggtgacacattaaacaaataacacattaaagtaagaacatcacatgtaagtccattcataactgcgaagggcctctatacaacgttcaacaacagcatgtgcttgatgaagcacaggatctctttttatgtatacatgaaatagtgaattataaaatattaagtgcccctcaatccaaatgtatttggtttttttcaaacaactcctgagtaaatcaattgtatttgaaagctgcaaaaacaaaaacaaaaacaaaaaaactccatgtctttttgtttctagaaatatgattattcaaatgaaaaatatttgtagcctaagggtatctgctattctataagtgccataattgtaaatgctaaaattaagtttagagaaagccttaaaagttagttcttcagctaataaacagcacagaaagtactaatagcaaaaagctccaaaatggtttttgtcattttaataccaatcattggggaattaggaaattgcctgactttaggacttctagagaccttaatctgttaattctattcctttatcctctataataatggtaacaaagtaactgtaataaagtaacaaaagacagggcttttcttttagggcaagttcttctcataggatgctaaaatttcctttctaaaaaactgaggacttttttcaaattataaaagtaatacatgcttgttatatatcttatataatgtagttatatgtgtatgtttcaagcagagaagggtttaaaatggaaatcaaaactcttctaatccacatcccagaggtaatcattggtatctctcttatcaggataatcgtaacaggttttagtgtaaatatccttccagatttttactatcatatacatacatacatacatataattttaggtcaaaaatagattcatatctactttatgtaacttcccttttgcctacttagcaatatataagaaatttttccatatcagtacatatatagatgtacttgtttctatttagtagctgaacagtgttctaaagaagaggtgcaccatatttaatcgctagccaaatggtaggcagttaggctgtttttgatttttgccattataaagtattatatctactgtctcatactctaaagaatgtatatccagtaaaagtgaatcatcccctaacttggcaattaacttatacaatctacaaaatgtttgaagtgagtttgagaagataaatatgccctgtaaagaatctaatagcagtcagtactttaagacataaaatatacataagctataaggttatgaagaatgatacaatgaacacccatgtacctaaatagtatattatcattacattggaagatccccatgtttactgcccctcctctgtgtcccgcagaggtaattttcttaaatattttgtttcttattaccttagttttaaaaaaatacttttaccacgtatgtttgtatcattagattaaatatccttaaatagtatataacatgcacttgaattttgtaaagtggatccatattatagttgaattgtccttttttttcttttttcctttttatttttctgtaactcatgacagtgctgaattgtctttttatttttgtacagaattatcttctttaagattcatctacatcatcctttgtaactgcagttcatttattttctctgatatataatattctagtgtaagaagatataagttatccattctagtgttggttggcatatgagtcatttcaagttttctgctattttgaacaatcttgccattaacatttttgtacatgtctcttgatgtatgtgggcaagagctcctctaggaaggaaatcactaggtgatagagtacgcttcatatgcagctttataagataatgaccaataatcttatttctcatatcttattaaaatttctaaagtagctataccaacttacacgttcactagcagagtttatatactctatttgttccatacatttgtttgatattatcagactttttaattcttgccagtgagtgtaaaaggctctgcttatagttttaatttgcatttcttcaattattgacacagatcatcttgttatacacttatcatccaagtgggtttccttaactcttttttttttttttttggagatcttatgttaggctgatttataagtgctgctctgggcagttacacaatttgtttatagtaaggagttgtctgactttgagcatactgtacttggcgattagaagtcatcatggcaagagaaaaccacagctggccccctgaagcaaacacaaaaaccagagaatggtagcggaaatgtagagataaaggtggggtttgtttcttattacaaaagaaaaaaataactgctcagtagtcttaacaaaagaatggaatatttcacactgggagaaaagacattgggatacaaaatttcaagtgttttgactctagccctgtccccatatccttcaagagcagaggcagaaggagacagttaaagcaaacaggcaattctgcaaaaattacttagaaactctacagatttgattaaaatctaaacttctattttgttttttaaaaatttaatatatcaaaagtcctgctttagtgacatgttattcccaccagaaaataaccccaatattccctctgtcagtaacatgctcaagttgaccagctaactcttacctctaaacccatgtggacaagtatatgtcttttaaaccaaagccatggggatcaagtgactgctagtaacatgtcgtctgttaactgaccagtattcgtcttctccagagggtgggcagggcacagaaaccctagagtggtcatgaaggactaaccgcaaatcaacaactttcaagcaccacttccctcactccttactcaaaaggggctacttaatttctgtctagattatttgctttgaatttggtatcccgtgacctgtatgttgtttctcccttagcaaaacacacataagccacaaaactatatatataatcttcttgtttttatttttttttttgagacagattcttgctctgtcgcccaggctggagtgcagtggcatgatctcggctcattgcaacctccaactcctgggttcaagcgattctcctgcctcagcctcctgaatagctgggactacagacgcctgccaccatgcccggctaattttttgtatttttagtagagtcagggtttcgccatgttggccaggatggtcccaatctccagacctcgtgatccacctgccttggcctcccaaagtgctggaattacaggcatgagccactgcacccgacccttgtttttacatttaaatataaaaacactactctgttttgtgtgataaatagaggaccaagcaaaaagaacctcttcttcttttaaggtagggatatccatcagtttatactaagctttgtgttcagaggagagcatttcaccccaagctaggctagtcccacacaagcaggagaccaagggcattctcctccctgatccccaacccctaccttctctcctaatccctacttttgtagaaagttggttataatcttttaagaaacatttccaccacaaagggaaatcctaacctaaccagaataagtcaggtcttcccctctcaggtccctcaaagaaaaaatccccctccttcaaacatgcagtctgttccgatagctacgcttattgaacaggcacaccccgttaaatggaagcagtggttatgtttcaccacccagctccccactaatgtactaaaaagcttcagtgatagggaaagaaaaggagggtaaagatgtgaagaaattaataatttgaccccttatcccagccaaagaaagaaagcaagattaactgggcacaaggaatttaaaaagaccctcatattccatcctttcttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcctgatccgcccgcctcggcctcccaaagtgctgggattacaggcgtgagcatcctttcagttacaattaggacaactgggagaggggaagagttggagttggatgaagtactaggaggggcttgacagctggaggtctagttcacttagtttttgtactggaagggctcaactccggtttgagaagacacgggcagatgagggcttctgtcaccgaaaatgggtcacagtcggcagagaggcaatgatcttcaaagtaacccttcttctcctggccaacagtctggggaatgtgtatgctggcactatgatgggctataagagcagaaaagtcgttgatgttagaagtttcatgggaatgtggatgtggtactgctgttgcttgcttagtttcttgatggcctcctcaatgtatttcagaccattctcccgcatggccttggtgctaatgttggtatggcagcctgcaccattccagttcccaggaatgggcttaggatcaaaggttgctatcactccgaagtcttcacatacacgatgtaagatgaaacaggtcacccagagatgatcttccatgctgattccttcacagggtccgatttggaatttccactgggcaggcatgacctcagcattagtccctgcaatcttgactccagaatacaagcaggcccggtaatgagcctccacaatgtccctgccataggttttgtctgctcacatactacagttaagatggaccctggggctcagggaatccactggaaggccaaccaaaggggtgcccgtctgtccccatgagattatatattcctgctccatgccaaaccaggggtgctggttgctcaccatgtcccttatccgtttacaggtgtgcctcaaattggtctctgcaggctttcgattgcacttgaaaacttcacagaacaccagcttgtggaggtccttgtggaaggggtcccaaaacatggcagcaggcatgagatacatgtcactgttggaaccttcaaagtactagagccaccaaaattctactcaggtaactcttccacacgcttgggttcacttgcagcgcagtcttgcttgagtaccatcgattcagatatacatggcctggactttctcaccctgaggtagggacatgtacacctgcttgacgcctctgtttaagtgggagcttgctgagatggtcatggtggaaggtgttctgggcactgagcaggcgggtaggtaaaggtaggctgcgagagtgaggagaggagagaggaggggaggccactgtgcgctcagaaactctgctcttctcccattctcggctctgccttttaagatacttaaatcttttgctcattttcaagttaggttgtctttttgaaaaaatactgatttgtagggttttttcttttttaaagagatggggtcttgataagttgtctaggctggagttcagtggctattgataggcgcaattatagtgtactgcagcctaactcctgggctcatgtgattctcctatctcagctacctgagtagctgggactatagatgcacaccaccatgcctggcttatagttcttgtaatcggagcattaacctctctctctgaggtttatgttttccctctctctatggtatcttttaatgaacagaagttcttaattttaatgtagtcaaatttatcaatcttttcttttaacattggcactagttgtgactagtttaacaaatctttccctaccccaaattcatatggatatttcctgtattatgtttgaaaacttttaagctttatagattagctttttttggctcttcatatttaagtctttaatacatgtggaaatgattcttgtgtgtggtgggaggtatctatgcattttttgtatcaatggtatgttatgtgtacatgtcccagcactattaattgaactgctcatcttttcactgctggtgccaattttgccataaatcgtgtttccatatatgtgtgcatttgtttctgggctttctattttattctgttggtcaatttgtttataagtgtgccaattctacactgtcttaaataataataattattattattttttgagacggagtttcgctctttcacccaggctggagtgcagtggcacgatctcagctcactgcaacctccgccttctggtttcaagtgattctcctgcctcagcctcctgcgtagctgggattacaggcgcctgccatcaagcctggctaatttttgtatttttagtagagatggggtttcaccatgctggccaggctggttttggactcctgaccttgtagtctgcccacctcggcctcccaaagtgctgggattacaggcatgagccactgtgcctggccaaataatataatcttaaactaaatttttgatacctgacaaggtaaattgctgtgctttgttgtttttctttaggagtatattggtaattttaaggcttttattcttctgtttaaggttctgataggaattgcattgtctctgtagattgttttggggagaattgatatctttaacatattgagtcttccattccatacaaatgatacattttctcatttatttaggccttgtttctttcataaatttgattaattatatcctataattcttgctttccaatgtaccaatatttaacatgcatttatttactttgtctggagtcccacggatgatctttgaagtcttaatatttaattacatttccaccttgtgcaaaatgtttgagaaaggaactttacattacctctcaacagaatgccaatgtcatagactctctaacaagggaggcaggatgaggaaacaagattattagcttctcctaaattgtcctcactgttttgtgggaagtttgtttctgaaagatcatacacacattttgaagccaagtggaaattttgttgttgtgctttacaaacacaaagtacttaaatacttaattaagtaattcatttatcgtttggattatccaccattcattgtcctctgcttggacaactgaaaactgactgaaaagggctgatgtgactatagacattaagtaatatataactgaatgctttaaagatgacttttcattttcaaagaacttgcttatattacagaactagtaaaataatctagcattttcaaagagaaaacaaagaaagaacaaaaactcttaatatttatgccaagtaataaaaaagtatttgacagaaatgatagagatactgacgcttcatcctattagctgtggtaggctcaagaactgatatattggtaattacaaaatattctggaaaaatgaaaagtattctcaaataagaggaataatctgaaagaactacaaattacctgtagagtacaattcatcatccttattatgtagtcaaactgttgatggtctaatattgcccggttttgctggacatgcaaacccaattcatcagtgagacactgtcttgctgcctttcctttaagggctctgagtgcagcaggaagggtctgaggacaagagaggtacaaatgaccaaatggtaccactgggggaaacaacaactttcaaacaatcatcctgaaaattcaaacgcatcctataatttatttaacatagttattagtaaaattaaactcctagggaataggtgatttattattaagacaattataaaatagatttgtggttatttttatatgtaaaccagcaagaaatataagataattatgtgataaattgaaaaacatttaatttcactatttttcttcaagttaacaaaactttggttaccaaattgactgttgcttcagatcatgagtcaaagccatagatacgtaagacacctttctataactagtaaattttccatggcaagaacagaaagaaaaattaaaacaataagaaatacaagtgatttcatacttttaaactggttggctgcttaatcactattcagctttaaattatgactgaaaagttctacaatctcttctcatttaaatatcataaaaaaggaaagaaaaaggactcggagttgcaaaaacagatatctctaggtgtatgcattaaaactcttttcgctttacaacaggcacatccataaagatgcctccttcagttcaccatgtaggacttagttaatttacttcacatataataataataagcttatttagctaaaaaatcagaacaaaggagaaaacaagaagtaggagggcatgatatcactaaaggtgggtataagaaataggatgtgaaagttgaaagcaaaagaagtgaaagacttcaactctaagaaaacatagaaaccaaaaagcacaaaatgtaaagagcactgggtcagtcagtgtaaaggtaaacatttctacatgctttaaccaacccctgaaaatagatattcagaactatgacaatgagtcagtaagaaagggttacattatgttcagcatgtttcattgaagaaggcaagaaaacatgctctaaggaggcacatttaagttcaatactacagttcctataattcattacatattctaactagattctttgcaatacataaaattatattaaaatgttaagttttggccaagcatgttggctcatacatgtaatcccagcactttgggaggctgaggcggctggatcacttgagggcaggagttcaagaccagtctggccaacatggtgaaaccccatctttactaaaaatacaaaaatgaggcgggcgcagtggtgcgtgcctgtagtcccagctacttgggaggctgaggcaggagaatcgcttgaacttgggacgtagaggctgcagtgagccaagatcatgtcactgtactccagcctgggtgacagagcaagactctggctccaaaaataaaaataaaatgaaaaaaattttaagtttctaagtaatatcccaaaatagtgttttgtgaacaatgtttaaaagtttgacagaaaaaattactatgaatatatttctggtggtcatataattaagcttggcccaacagctttaaatcttagacactattcatttaaaatgatccaaacaatgagaggatactttattaggaaaagggatagaattaaagaagagagaagctggtaacctcagcacgtaaatctgaaagggaaatgataaatgcttacttgggaaagatcacattttattaccttttcagtttccaaaattttattttcaaatatgaatgagatacagtttctgacaacttctagtctttgtgcactgttgaaaactgtcgtcaccttgtccattatcgaaactagtaaaagaatataaagaaagcacaaataaattaaacttctttggtaattacaaaagcaaagagactactactttaagactgtaggttgggcgtggaggctcacacccgtaatcccagcaatttgggaggctgaggtgggatgatcccttgagcccagaggtttgagacaagcctgggcaacatagcaagacccttgtctacaaaaaatacaaaaattagccgggcatggtgtcttgcactgtaatcccagtgactcgggaggctgaggtcggaggatcacttgagcccaggagtccaagtctgcggtgagctaggacagcactactgaactgcagctgggtgacagagtgagaccacatctcttattagaaaacaaacaaaaactgttgatatgacctacaccttattttttcccttattacagagcattgaaagtattccatatcattattttgattacatgttccagtgttgaagtatcaggctagctgattaataatttcacagggtagattctaatgagacacttaacttttatgcaaactaattcacattgcaaagtaaaattatattaaacaaaggcaaacatctattttaaactttgtttacaactagtaatattgttaatatttctaagatattaccaaagaaaaactacattccacaaaatattagatattacacatttgagtagaggggacttgaaagaaagtagtgcaaacaaagagaaacgatcatgatcaatgaactgttacactggcttaggaaagtcactttttagtcatgcaaacctagcacctttcaccttttaccatagggttagaaaattctagtgtattacctaggctactaagctagttacctaaataaatttaacttattaaaataatattagaaggatataaatgaaagtagtatttatataaaatttatactttcacaaagaactatactatgccatttgtttaaatgaggtagtatcaatagtttttttttgcataaatttaaggggtacaagtgcagccttgtcacatggacatactgcatagtggtgaagtctgggcttttagtgtatccatcaaccaaaatgatgtatattgtagccattaagtaatttctcatccctcactcccttcccaccctcccagccttctgagtcaccagcgtcttattattccacacttgatgtccatgtgtacacattatttagctcccatttataagtgagaatagtatcaatggttctcaagccaaaaagactacttatattttatggctactctttggattctaaaggcacaatcccttcaccttctcccatacctaagaagaaagactatcatattttactcattagcattcctttcatctcatcaatacaaaacctatattcgtcaaataatgttttaaactttttttttttttttttttttgagacagagtttcactcttattgcccaggctggagtgcaatggcacgatctcggctgcctcccaggttcaagtgattctcctgcctcagcctcccaagtagctgggattacaggcatgcgccaccacacccggctaatttcgtatttttagtagagacagcggttctctatgttgctcaggctagtcttgaactcccgacctcaggtgatacgccgacctcggcctcccaaagtgctgggattacaggtatgagccaccgcgcccagccttaaactttttaataaaactaattatatgctcacaataagctgcaaatgtaatacaaagaagatctttgtactcatcacccagcttccccctatggtgacatctttcataattatgctttattaggatcaggaaaacaactggcataatacaatgaatgagactatagaccttacttgaattttaccagttttcttcaaatcatttttaatcatgtaacattaatttcctggttaaactgattatttcacgtgacttttctctctgaaatgctcattcataattgtgggctctggtgcttcccacacacataggttggtggcattaactgaaaatctatctatattagaatagaaaacttacaatctccaattaataacacactttattgagagagcaatgtgtttatgtttataaacttttaaatctaaaatatctttagcagtattttaaattttctttaggctgagttattagaaaaaaacatattttctttttctttttcttttttttttgtgagacagagtcttgctctgtcaccaaggctggagtacagtggtgcgatcttggctcactgcaacctctgcctcctgggttcaagtgattctcctcctgccttagcctcccaagtagctgggactacaggtgcataccaccacgcctggctaattttttgtatttttagtagagatggagtttcaccgtgttggccaggctggtcttgaactcctgacctcaagtgatccgcccaccttggcttcccaaagtgctgggattatgggcgtgagccaccacgcccagccagaaaacatattttcttgtaataaatatgtttactatctggaatttttttcctttggagaatccaacctaattcacattttatacatgcatctaattaaccaacttcaaaatatatcaagaaaaacaggaaaaactgaaaaatagggaattctgctattataatgggagactttaatatttcttcctcaatagctgaaaaaaagacaaaagttagtaaaggaagacaactcacagaatggggaaaaattagcaaataatatatctggtaggggacttatatatagaatatagagagtatgcttacaactcaataataaaaaggcaaatagcccaatttcaaaatgggcaaagagacagtgaaatgaccaatagcacatgaaaaaatgttcagtatcagtggctgaaattagaacgaaagaaatctaaaatggcacgaccgctttggaaaatggtttggcagctcctcaaaacattaaacatagaattaccatatgacccagcaattccaatcctaagtatacatccaagagaactgaaaacatatctacacaaaatcttgcacataaatgttcacagcagcattattcataatagccaaaatgtagaaccaactcaaatatccatcaattgatggataaataaccaatgtgatatatatccaaacaacggagtattattcagacatttaaaaataaatgaggcctggcacagaggctcacgcctgtaatcccaggactttgggaggccgaggagggcagatcacgaggtcaggaggtcaagaccatcctggctaacacagtgaaaccccgtctctactaaaaatacaaaaaaattagccgggcctggtggcgggcgcctggagtcccagctactcaagaggctgaggcaggagaacggtgtgagcccgggaggcggagcttgcagtgagccgagattgctccactgcactccagcctgggtgacagagcgagactccgtctcaaaaaaaaaaaaaaaagaaacgaaatgctgatacatgctacaacatagacgtacattggaaatattatgctaaatgaaagaagccagtcataaaagattacattttgtataattctatttatataaaatgtccagaatacgtaaagctatgaagacagaaagtagattactgtataaggctggggagaaggtggtttggggaggaaatggggagtgactgctaataggtgtgaggtttctatttaggttataaaaacattcttgccgggtgcagtggctcacgactgtaatcccaacactttgggaggccaaggtgggcggatcacctgaggtcgggagttcgagaccagcctgactaacatggagaaactctgtctctactaaaaatacaaaattagctgggcgaggtggcacatgcctgtaatcccagctactcaggaggttgaggcaagagaattgcttgaacccaggaggcagaagttacggtgagccgagatcacaccattgtactccagcctgggcaacaagggtgaaactcaatctgtctgtctgtctgtctgtctgtctgtctgtctgtctctctctctctctctctctctctatatatatatatatatataaaatatatatatattctcaaattaaatagtaataatggttgaatgagtctgtaaatatactaaaaatcatgggatcgcacattttacattggtgaatttacagtatgtaacatatctcaataaagctgttattaaaaaaagaaaagattctatagtggcagtggttgggttatgattaccctttttgggaggcagtgaatgaaacagtttctgagtattgataatgctctgattctagctacaggagtttgttcactttgtgaaaattcatcaaattgcacacttttcctttttgggtcttacatccttataaacagtttacttttaaaacagacagacaaatacataccaacaggtggacctgctggcacaacacatttcttttctattcgtgtggcaggaggtgcattctggttcttagcaacattttcctgtattaattcctgaacccgggcttcattaatctctgggaaaggaagaatatgaactcgcaaatgggatccttctgttggccgtggaactttctggaatgccatatgaggatttggattctcctgtaatatcagacataggtaaaattactccaagttaaaataacaatggcagatcaccaggaagggagtgggagcttacagggacacgagctgggtagttatacatacattcatatatacgccataaaacatgaagtaccaaaatcttacttcttcttacatgctctatcagcagcatctgatacagcttggcatctgtcttcctcttccatgaacactttctttacttggtttctaggtcttcttgctacatctttgtctatttctcatctccctaatcccttaacaatgtgaatatctcagggctcagtccttgggtcttttttctattaacattcattccttggtgatcacttccagtctcctatctttaaaccataaaaataccaacaattcacaagtttttttctttaaacaagttttctcctaaaccccatacccacatgtttaactctctatacaatattttcacttggattttttaaaaaattctaaacctatgtccagaatgcagctcttaatcttcacccacctctatccctgctttcttcagtcttcctcacatcagtaaatggcacatttattttttccaatcatttagacaaaaagcttagagttatctttaatgccattctctaacacccaactatccattcctctgcagatcttgtggacttgacctttaaaatgtttacaacttggccagtttcacaacactttggttcaagtcaacacctcacgttacagcaatacaacagtctcctagtctccctgcttccacctgtactccttcattcaacactgcagactatgtgatctagttaagagtatgtcagttcatcacataaccgttctgttcattccaatggcttgtcatctcactcacaataaaacccaaagttcttaaaacaacttacaacaccctacaagatctggcctttctatatgatgtgtcctgccatgatttctttcatttttttctgctctagacacacagaacttcttgttcctgactcaaagcctttgcacttaactgttctctctgcctggaatgcctgtgccccatgaatctgtacagcatcctccttcctttcttgcatttcttagctcaaaagccacctttcccaatcaccttatcttaaattatactctcttccccaacacactccctatccctgttatatttttctctatatcacttatcactctctcacatactttacattttatttaacttgtttattgtctatccttctctccataaaataaagctccatgagagtagacgtatacctactgcatctagaaactgcctggcacacagcaggcactctaaagctcttcccactgcatcttaatgagggggacacaatgctgaacacacataaggattgcaagaattgaattaaatgtgtcagctaatatttttgtagactctttgggttggcatgaactttttagtcatctagttaagcaggattagatctcaaacactccaggtagaatggaatccattctttcataaagttctctagggaaggctgctttacaactattcttgaccaattctaacacttattctttgcgaccagaaaattccttattcccactgaacttatgttattcatgctgtagattaaactcaatactatcccatatatcctatttttttttttttttagacgcagtcttgctctgtcgcccaggctggagggcagtggcgtgatctcggctcactgcaagctccacctcccgggttcacaccattctcctgcctcagtctcccgaggagctgggacaacagggcccaccaccacgcccggctaattttttgtatttttagtagagacagggtttcactgtgttagccaggacggtcttgatttcctgacctcgtgatccacccgcctcagcctcccatacatcctcttgacacttaaaatggccaactgccatcacttcttagggctgctccccacaattctttttggttatatggcccagacctagataaagaaaatgttgggctaaggcagatgatatagctagtatgcctcagcaatataatagaaacacactgcttcctcccactgccgtaagtgtcaaaacacatgggttccagttcttgctctagtccttattatgtgatgcagggaaaacaactttgcctaagttatataattaagcttatcttatataaggctcctcagaaggtgaaatcagatttaaaatctgttcttgccaaagcagctctcatacatgctctgtatttccccccatatctagcaaagacagggaaaaataagtaagtaaatccttagtccaactcttagtaatcactctttctaaaccaaatgttgaaaaagtgttttacaattctgtctggacttaacaccaatgtcactggcctgtagtgtctaaaactgcccttttcaaaaagtagtgtttttgttcttctctgttctttaggcatgactcttactcatatactgtcttcccaaaaataataaatatcaattctctaaaacatattgggtaggtatcttttttttcaggctggccaggtaattcatatggatcttgaggtctgaattatttaaagtatattcattactttggtttctatctatattttctttataataaaaattaaaactctaaatatatttcccatgaagtaaatatttataataaaatttaaaacttggaaaaataaaagtagaaataatcttagtaacaccagtattttttctagttatatatatatatttttctctattgttatattatctgtcttctgtctttttccaaaaatgacttggggtggtttagaaaaagcaggatgcattggccaggcacagtgtcttatgcttatgtaatctcagcactttgggagttcggagtgggcagatcactttagtccaggagttcaagaccagtctgggcaacatagtgagaccccatttctacaaaaaaataaaaaattagccaggcatggtggtgcctgcccatggtcccagctactcaggggactgagggaggaggatagtttaagcctgggagatggaggctgtggtgagctgtgattgcaccaccacactccagcctgggtgacagagtgagaccttgtctcaagaaaggaaaaagaaaaagaaaaagaaggatgcacatatcacttctagtcaaaatctctaaagagttggtcctataatttggtaagttcatcctaaacttcatagggacatacaaagaccaaaaatagtcaaggaaattctgaagaagagttaagtgggagagttaagatttccagatatcaaaacttacataaacctttaataattaatacagtacaacaactgttattagtgaagggttaaaaggatgaatggaatagaatagagagccccaaaacaggactatgtgagaaaatatgatagagataggtggcatgacaattcagggggaaaggttagacaattcaatgagaggtagtataacaaagtatttttagttcatgatctctgatttcagaacgcctcgtttcaaactctagcttggccacttactagtagtgtgacctggtgcagtgtcaattcacttaccccatgtgttgtagttttcacatctgtaaggaagataataatatagtacctacttcataaggttcttatgagtattgaacgagctgttacagtaaagctgttagaacacacaaacacacacacacacaccaccccagaatgaatctaaaggctgttttccaaaaattttggctacattcatttaaaaaatatgtattctcttattctctgcatattctatggcatggtaccatgcttctataactaaagccatctctttctcccaagatttccaacacattaccaactacttacattttagtaattatagtagtagtatccaatatgttttttgtttgtttgtttgtttttgagacagagtttcactttgttgtccaggctggggtgcagtggcgcgatctctgctcgctgcaacctctgcctcccgggttcaagtgattcttctgcctcagcctcccaagtagctgggattacaggtgtgcaccaccacgcctggctaattcttttgtatttttagtagagacggggtttcactatgttgttcaggctggtctcaaacttctgacctcgtgatccaccagcctcagcctcccaaagcgctgggattacaggcgtaagccaccacgcccagccctccaataagttttaaatagagtcttcccagaagcaattagaaatattgtaaaccaaatccatacacaatttagaattacaagcattaatttacaagcttgtaaaaaagatcatgttaaaacaaagttcaaagttgaatatctgtagttatatagatattctacaccaaaatgcagattagggattttgttaaattatgatatatttagctgtgtttagaagattcgaaaaagacttatgccccagaatacagtaatatttggttttctggctcctgagtctgtatactgctgccctctaacgggcagcatgataaatgtaaaggaccacatttgctaccttgaacctaacttggtcgcgaaatgacttttgagaagacaatagcaatgagaggaagtttagggtagggctcactgtattctgcatatacttaaaaacatctgcttttacttgtaacacaagatgtgtttggactggtcccttgaacgtcaccaagctcattaaaagctacagccaaattttgtgttgaatctccttgttgaaataaggaaatccgttattttccgacagtacaaagcagcagccaaattttcatctttgattccagagaaatgcaaatataaagtaataaacaagggctagacaactaaacacttacagtgaacctggcaacatttttttccaaagtaaccaaaataaactactgaaaagagtttggcagaatgcactgtcttttacattttgaatttggataatgattttcaaggaatggtctctataatcctgctttaagagtatactttagtaattcgaggtagaatgatttttctcagacatgaaaaagtgacatatacacacatcatctggtctgcagcacccctcccccctgcagcacgcccagctacccccagctttggtaggctaagtgagaatatgcctaggggttacagaatacaaggcttgaaactaatttcaaataaaagcaaagcaaggcacaacaaaagccccaaaccccaatggaaattcaaagtaggcaacagccaccttgggaaaaagaaaatttttcctatgtattggtctcagcactgaaagacaaatcaatatgatattgttagagcttatcaagtttcccagattaattcaagtatttgaaattatttaacgtgcacaaattatacttagagctatgtgggatagcaagtgacacaaattttttttctaatacagttgatggcaatactgtcactggagtaaattgttaaacattgtcaaaacgtaactggactctttagagttgcctggtagtgtacatgacattgatggaatgactcatcctcaattttccaacttcataggactttcaaggatcacatccttgtgagatgactgagacattcaactgaatgtcttatccttaatacaagtagatgactttaatatttgatatgctggttgccctaattcagggtttctcaacctatgcactaattgacatttgggcttgataattatttgcgataaagagtaggtgtcttgtgtattgtaagatgtttagaagtatctttggcctttatccactagatgacagtagcacagtccctccaactgtgaccaccaaaaatgtctccagaccaatttcatgaagtagggtgggagggttgctcctgttgagaaccactgctctaattcatgactccagatagagatttcctattctaagacaagtactcttgtcacaagtacgaaggcaacatacagtgaccagctaacagtcctatactctcactcacctgctgaaatacaaattagaatcacaatgagataccaccacatacctgttggaaaggctaaaacaagacacccccaacaccgcccaaaaaaaaaaaaaaaagaaaagaaagaaaccagccgggtgcagtagctcatgcctataatcccagcactttgcgaggccgaggcgggtggctcacgggagttcgagaccagcctgatcaacatggagaaaccccgcctctactaaaaatataaaattagccaggtgtggtggtgtatgcctataatcccagctacttgggaggctgaggcaggagaatcgcttgaacccaggaggcagaggttgtgatgagtcaagattgtgccatggcactccagcctgggcaacaacagcgaaactttgactcaaaaaaaaaaaaaaaaaaaaaaaaaaaagaaaaaaagaaaccaactgacaataccaagtgttagtaaagatgtggcacaaatggaatgctaatatactgctggtgaaaatgcaaaataacgtagacacttgagaaaacagtttggcagtttcctatacagttaaatattgtattaccatatattccagcctcccactcctaggtattcatacaagagaaatgaaaacttatatttatacaaaaacttatgcaaatgtttggggtggttttattcattattgctaaaattgtctttcagttggtcaacaggtaaataaaactttagtccatccataaagtggattaccactcagaaaaaggaataaacaactgtatgaagcaacatgattgaatctgaaatgcactgtgctaagtgaatgaagctaaactcaaaaaactacataatgccattatggaaaaggcaaaactatacagacaaaaaaattgatcagtggttgccaagtgtttgaggtggtgggaagatgtgactataaaggagaattaaggaactttgggggagtgatagaaatactctacctacttattgtgatgctagtggttgtatgacttcatgcatttgtcaaaactcgtaactgtagattaaaaagtatacattttactgtatataaaaattagatcatgataaacctgacttataagtgaacaaagaaatcagataggacgggaggggggttcaatttgaagcctatgctttgcgggcagggcttcatttcatcatcattatctatataagtcgtttatgtctatgtcttgactctctaaaggtaatcacaatattttacttccttcctataattaaaaaattcctttattcacagttggcaaacagtataaatatcatcagtgtagatgacatgtagtgaaattaacctggtagtgaaattaacattttgcggaaatgtaaagggcgtagattttatttgatttggactagttatttcttgtatttgagttttgttctcccattaggattctatttggttcaatgctgggcaatgaaatatccataaggcacaattataaatctcatattcttcttcttcttcttcttctttttttttttttttttttgagacgaagtcttgtcttgctgcccaggctggagtgcaatgacgtgatctcggctcactgcaacctttgcctcccaggttcaagcgattctcctgcctcagcctcccgagtagctgggattacaggcacatgccaccacacctggctaattttttgtatctttagtagagatgtgtttcaccatgttgggcaggctggtctccaactcctgacctcatgatctgcccgcctcggtcttccaaagtgctgggattacaggcgtgagccactgcgcctggcccagatatctgatattattttacacagaattttaagttctttaatatttcctttaactttttctaaaactgtcagacaaagccaggtatggtggtaagtgtctgtagtcccagctacttgggagcgtgaggtgggaggatcgcttgagcccagaagtttgaggctgtagtgcattatgtttatgcccgtgaatagccactgtacttcagcctgggcaacaaagcgagacaccacctccaaaataaaaagcaaaaaacaataaaacaaaaattgtcaaattacatatctagcaaatatttttatactattgcagatgcaaaacaaattacaaaaactgtactatgtaaaacaataaaacacatgtccaactgatttcttttctttttttttgttgttgttgttttttgtttttttttgagatggagtctcgctctgttgcccaggctggagtgcagtggcgtgatctcggctcactgcaacctccacctcccgggttcacgccattctcctgcctcagcctctccgagtagctgggactacacgcgcccaccaccatgcccagctaatttttttgtatttttagtagagacggggtttcaccgtggtctcgatttcctgacctcgtgatccacctgcctcagtctcccaaagtgctgggattacaagcgtgagccaccgcaccccacccaactgatttcttaatgccctgaagtagaagttttatgaagttcttgtcttggcctatctttttgtcttggcctatcttaatgttctcactttgtgaaaacatttattagtggtcctttatatgtgcatatcaagaatcatagaggccaggggcattggcttacccctgtaatcccaacattttaggaggctgaggtaggaggactgcttgaggctaggagttcaagaccatcctgggcaacatagtgagaccctatctctacaaaaaaattacaaaaaattagctaggcatggtgatgtgtgcctgtagtcccagctactaggaaggctgaagcaggaggattgcttgaacctaggaggtcaaggttgcaatgagctatgatcaagccactgcactcctttctgggtgacagggcatgaccctgtctctttaagaaaaaaaaaaaaaaagaatcatagggatagggcagggaagtagttacttgtgttctcatgcagacactgaagattctgaaagccaaaaaagtaggccaactcctacattatgaattgggaatggaaagaagctgcatagaggtgttgccgataatctctgttacaatatcttttttacaataatctttgttaccaatgcttacactgtttgtctctagtgggtttagtcatttccttctccttccttccacctaacccattcccccaaagtcaccaaatgcctttcttaattatttgggaagctccagaaagctaaaagagcagctaagctcagttacaattcatcctactcacattcctaaaatctcactaaaaagcaatataaaggagtggtgagaagagacaggaaaattaaggtgtatttttgaggtgcttcaaagggaaatgaaaagagggcctagatacacataccagacttcagtgcaataaagtatttacaaacatctgaatggaatcaccaggtctcaattccaacccaataacaaggaaagagtcaaattagatggctggttcttgcttatcaaaagggaattttagaaatgtgattaaaaaaacaacaactgactagttaaaaatagaaccatgtggattattttcctcgcattgataccatcctgcctcccttcccccaatttcctgcataacctaagaaagtaactttactatcatgttctgttttttaactttataaagtatttacttcatgaatgatgattttgtcatcacggacttcagaatcttagcactagaaggaatctcagacaatctaatgacaatccactgggacagtcacaaattcttacttgtcatgtctgtgtatccttttctgaaggatattaggagaattacgtacctagaatatgcctggcactaataagtacttaactaatagaatttattaaattaaatgaaatataattagattgtgaaaaaaatttccaataaggcctatgaaatgtagaagacatttgaagggctcttacctagtaatataatctcttaataataatacttcacgatgatcacttttaaagtgtcaattttaaagaatagggattgtccatgtttttgtttgtttgattgtttttgtttgtttgtttttgtttttgagacagggtctcactttatcacccatgctggagtgtggtggcaggacttcggctcaatgtagcctcaaccttctgggctcaagcctcgacctccttggccgaggcgagtggatcccttgagcccaggagttccagatcagcctgggcaacacggtgaaactccgtctccaccaaaaaatacaaaaaaagtagctgggtgtggtggcatacgcctgtagtcccagctactcaggaggctgaggtaggaggattgctggagcccaggaggtcgaggctgcagtaagccgagattgtgccactgcactccagcctgggcaacagagtgagatcttgtctcaaacaaacaaaaagaacaacatgtaaagtcaactactggaaacatcgttttttcctattggaggcgatccagccttatagtgaaagaacataggcttaggaaatgaatagatgaaaattcctaatttaaaatctggatttaatcacttaagagtcatatgattctgagccaattagccccactaaaatggggataatgacacctgccttacattgtcgttatgaggatgagagataattgtatgtaaagtgcttaattccatgcctggcacaatatagctaactgctctcatgcagacactgaagattctgaaagccaaagtgggccaactcctgcatcatcaactgagcatggaaagaaaagcagtatgtttatacatgaactcaatatttattattattataataggtcaaaagaaatttctcatatgatcatgctgtaattacttctacacagccactataagtggcaaagaccagcatacaacacaagttttccttctaacagaattctaccagatttcttttttaagttttagtatactaatcaggaaacacatttattatatcaggcatggttataaataactaaaaatgtgatcagtcaataaattaaagtaacagatcttggcatgcaagttgccagaaaaataatttatttatacttttgctaaaccagtattatgatttaatgtgtgatgtatttagaaatctgaaaatattgcttcttagtaaagaagctaataatctacaagtaacagtcaattaaagtacttctgtgttaagtaatttaaaattgaaattaaattcatctttttttttttttttttgagacagggtcttgctctgttgcccaggctggagtacggtggctcaatcatagcttactgcagcctcaaactccttggctgaactcctgggctcaagcaatcctcccacctcagtctcctgaacaggcaggactataggtgtccatcaccacatgtaatttttttttttttcaagacagagtcttgctctgtcatctaggctggatgcagtggtgtgatctcggctcactgcaacctctgcctcccgggttcaagcagttctcctgcctcagcctcccaaatggttaggattacaggcacgtgccaccatgcccggctaatttttgtatttttagtagagacgggatttcaccatgttggccaagctggtctcgaactcctgacctcaagtgatctgcccgcctcagcctcccaaatgctgggattacaggcatgagccaccatacccagcctcttgtaattaaaaaaaaaaaaaaaaaaaaaaaatttgtagagatggagtctcactatattacccaggctggtctcgaactcctagccccaagcaatcctcctgcctcggcctcccaaagtgctgagatcacaggcatgagccaccacactcagcctaaattcatcttttaacaggcacaagaaatgttatggctaatgatttctgcatgtgttagtaatattactgctcccttaatattactggcagaccatatctatttccagaatttataatgaaccactagcaattgataaaacagaacttaagaatttttttttttttttaagacggagtctcactctgttgcccaggctggagtgcagtggcgagatctcggcttactgcaagctccggttcacgccattctcctgcctcagcctccggagttactgggactacaggcgcctgacaccgcgcccggctaattttttgtattttttgtagagatggggtttcactgtggtctcgatctcctgactttgtgatctgcctgcctcggcctcccaaagtgctgggattacaggcatgagccactgcgcccagcaataattttctatttaccaaaatttagataagcataattcataaaagatggatttttttgttttaatatgaaacctctgaactttactttgttctctttcaaaaaagtatttattccctcaaagaaagatcacattctaaatgtagaacttaaaactcagaaataatggaataacataaagaaacaaatgttttagtatccctgcttgtatccaattggttctcaaatttcaaatgaatgtgacaaagcactgactaataatccagtgtccaaaaaggtccatctagtcaaatcactaaattaaacaatacctgttgtgagtcaagatactgaccctgaattcttcttcactatttccttaaaaatacatcttccccagaagctaaataagtggtactcattaaagctggcaacaatagacaccgaggactactagacaggggaggaaaggagtagggaaaggggtgaaaagtgactactgggtactctgctcagtgcctgggtgatggcatcaatcgtaccctaaacctcagcatcacacactaagcccagctaacaaatctgcacatgtgccccttaatctaaaataaaagttgaaattatttaaaaaacgtttgaaatcggcaaaaacaaaagtttacttgatttataatttcttttattttttcaagagatatacaaccaataaccaccatcttattagtaagattttaatgttcaattctatatttcccttatgaaaagactaatgagaaaatgtataaccattattatattttaatctttggatgccaatattatatttaaatcaatgatatggctttaaatttagatcggttgagttgtctttgcagaagttatttgctatacagataaagtatatgttagaaccacaaattaaaagaaaatttctactttgacaatgtttagattagaaacagtatcgaatgttacatttctgtcttccagaatatttttttgtttactaaagtcaggacctaatcgtaatgaaaaaaaatcacatcttccctcaacttttccctggaggactatagttccgacttactttacttttcttaggactcaaaacttcacagcagaagaaataaggaacactcattagcccaaatccatttttccatatgaatataatctctgtcattttatgctcttttctttcctggtgttcaaatagttatttcacactttatcacatccgagtccttttaacttactgcatttcctctatccatggaatattttcatccttgtgtttctgtggtcacttgtcaatttgctttttttctttcagcttttcgctccctctgttcaaaacaatgcaactcctgaccagctgacaaccgcagtgccaagccaaagcagaggacactggtcggttctgtctgaggtggttctggtctccagtgagtctaatctttatgtcttacaagagacccaaatgaaaaccataatgagggcaaatgactaactgaaaaaattgtgactaacatgttttcataacacactgactgacaggaaaattactttgaaaaatgtggtctattttgatatacagtaccaactgtaatatctcataatttacaatccagagcaaaaaaactatcacaggaagctttctagttctgtgaacaaaatactttatttaacagtatatttttaaaattaatgactgtctaaatagagtggatcatggcagatgggaggcaggactagattgcagctccagacagagaagcatgtggaggcttgcattgtgagtttcagctctagatcaactgcaagaacaaaccagcaatctggagaggaaccacagatcctcggaaggaagtgaactgctcctgcgggattcgggagacaccccaaatactgtgagtgccccaactgtctaagtgggaaagggagaccctcctctcccgaacacacaccggagaagctgaaggtctgtttgtgggagaagtttccgactttacctaaagctgagtcaagttagagagccaagcgaaatacaggggtagagaaagcagcagaaaggccctgggagcttgccgggtcccaaagcagcccattcctgcctggcaccacagggatccctcagaagggtggccagaggagcagcaggtaaaactccacagggagaaggaattctctagctgaactttttaactatttgaatggggtgagaagccccgggggtggtgggggctgcaaatccgggttgcagacttcacaggcaggggaagaactaaagcacttttctttcacagctgggaggcggatagcctcgggcaagttttcaagcccgtctggcagcccgtcttgccctctgcctggaaacagactcagggctactggggggcacagcgggagagaaactggcccttctgtttgcgtgggagctgggtgaggcctgtgactgccggctttcccccactttcctgacaacttgcatgactcagcagagggagccataatctccctaggtacacaactccagtgagctgggaatctcacccccatcccccacagcagctacatcaagacccgcccaaagagaatctgagctcagacaggcctagctccttcccaacctgatggtccttccctatccaccctggtagcagaagacaaagggcatattatcttgggagttcaagggccccgcccaccactggtccctctccacactactacacctgatgctttctggaaggcaccacctcctgacaggaggccaaccagcgcaaaaacagagcattaaaccaccaaagctaagggccctcatggagctcactgcaccctccgccacctccaccggaacaggcactggtatccacagctgagagacccatagacggttcacatcacaggactctgtgcagacaatcctcagtaccagcctggagccagggagactcgctgggtggctagatccaggagagacaacaatcactgcagttcggctcacagggagtcacatccataggaaaagagggagagtactacaccaagagaacactctgtgggacaaaataatctgaacaacagccttcagtcctagaccttccctctgacagagcttacccaaataagaaggaaccagaaaaccaaccctggtaatatgacaaaacaaggctcttcaacatccccccaaaaatcacactagttcactagtaatggatccaaaccaagaagaaatctctgattacctgaaaaagaactcaggaggttagttactaagctaatgagggagggagcagagaaaggcgaagcccaatgcaaggaaatccaaaaaatgatacaagaagtgaatggagaaatattcatagaaatagatagcttaaagagaaaacaataaaaaattcaagaaactttggacacacttttagaaatgggaaatgccctggaaagtcccagcaatagaactgaacaagtagaagaaagaaactcagagctggaagacaaggtctttgaattaacctaatccaacaaagacaaagaaaaaagggtaagaaaatatgaacaaagcctccaagaagtctgggattatgttaaatgaccaaacctaagaataatcgctgtatctgaggaagaagataattctaaaagcctggaaaacatatttgggggaataattgaggaaaacatccccggccttgcaagagacctagacatccaaatacaagcagcacaaagaacacctggaaattcattgcaaaaagatcttcgcctaggcacattgtcatcaggttattcaaagttaagacgaaggaaagaatcttaagagctatgagacagaagcaacaggtaacctataaagaaaaacctatcagattaacagcagatttctcagcagaaactctacaaactagaagagactggagccctatcttcagcctcctcaaacgaaacaattatcagccaagaattttgtatccagtgaaactaaacatcatatatgaaagaaagatacagtcatttttcagacaaacaaatgctgaaagaatttgccattaccaaaccaccactacaagaactgctaaaaggagctctaaatcttgaaacaaatcctggaaacatatcaaaacagaacctctttaaagcataaatcacacgggacctacaaaacaaaaatacaagttaaaaagcaataacaaaaaacaaaaccaaagcccacaggcaacgaagagcacgatgaaagcaacagtacctcacatttcaatactaacattgaatgtaaatgacctgaatgctccacttaaaagatacagaactgaagaatggataagaactcaccaatcaactatctgctgccttcaggagactcacctaacatacataacgactcacataaacttaaggtaaaggggtggaaaaaggcatttcatgcaaatgaacaccagaagcgagcaggggtagctattctttttagttgtttttttttgttttgttttgtttgagatagagtcctgctctgacattcaggctggcatacagtggtgctatcttggcttactgcaacctctgcctctcaggttcaagtgattttcctgcctcagcttcccaagtagctgggattacaggcactcgccaccatgcctggctaatttttgtatttttagtagagacagggtttcaccatgttggcaaggctggtctcaaactcctgacttcaggtgatcctcctgccttggcctcccaaagtgctgggattacaggtgtgcgacaccacgcctggctgggtagctattcttatatcaggcaaaacaaactgtaaagcaacagtggttaaaaaagacaaagaggcacagtatataatggtaaaaggccttctccagcaggaaaatatcacaatcctaaacatatatgcatctaatactggagctcccaaatttataaaacaattactaatagacctaagaaatgagatagacagcaacacaataatagtgggggacgtcaatactccactggcagcattagacaggtcatcaagacagaaagtcaacaaagaaacaatggatttaaactacatcttggaacaaatggacttaatggatatatacagaacatttcatccaactaccacagaatacccattctattcaacagcacatggaactttctccaagatagaccatatcataggacataaaacaagcctcaataaatttaagaaaactgaaattttatcaagcactctctcaaaccacagtggaataaaacaggaaattgacgccaaaaggaaccttcaaaacctgcaaatacatggaatttaaataacctgctcctgaatgagcattcagtcaaaaatgaaatcaagatggaaattaaaaaattcttcaagctgaatgacaataatgacacaacctatcaaaacctctgggatacagcaaaggcggtgctaagaggaaagttcacagccctaaatgcctacatcaaaaagtctgaaagagcacaaacagacaatctaaggtcatacctcaaggaactagagaaacaagaacaaaccaaatctaaacccagcagaagaaaggaaataaccaggatcagagcagaactaaatgaaattgaaacaaaaaaaaattacaaaagataaatgaaacaaaaagctggttctttgaaaagataaataaaattgatagaccattagcaagattaaccaagaaaagaagacagaaaatccaaataatctcactaagaaatgaaactggagatattacacctgacaccactgaaatacaaaggatcattcaaggcaacacctttacgcacataaactagaaaacctagaagagattgatacattcctggaaaaatacaaccctcctagcttaaatcaggaagaattagataccctgaacagaccgataacaagcagcaaaattgaaatggtaattaaaaaattaccaacaaaaaaaagtcgaggaccagatggattcacagcagaattctatcagacattcaatgaaacaccagtaccaatccttttgacactattccacaagatacagaaagaaggaactctccctaatttattctatgaagccagcatcaccctaatacccaaaccaggaaaggacataaccaaaaaagaaaactacagactaatatccttgatgaacacagatgctaaaatccttaacaaaatactagctaaccaaatccaacaacatatcagaaagataatccaccatgatcaagtgggtttcataccagggatgcagggataatttaacatacaagccaataaatgtgatacaccacataaacaaaataaaaaacagaaatcaaatgatcatttcaatagatgcagacaaagcactggacaaaatttagcatccctttatgattaaagctctcagcagaactggcatacgagggacataccttaatgtaataaaagccatctataacaaacccacagtcaccataatactgaattgggaaaagttgaaagcattccctctgagaactggaacaagtgcccactctcaccactccttttcaacatagtactggaagtcctagccagaacaatcagacaagagaaagaaataaagggcatctaaatcggtaaagaggaagtaaaactgtcactgtttgctgacggttataatcatttaccttgaaaaccccaaggactcctctagaaagctcctagaactgataaaagaattcagcaaagtttccggatctgagattaatgtacacaaatcagaagctcttcaataaaccaacagcgaccaagcagagaaccaaatcaagaactcaacccctttacaatagctgcaaaaaagttaaaatccttagtaatatatttaacaaaggagtccaaagaccgctacatggaaaactacaaaacactgctgaaaaaaatcacagacaatgcaaacaaatggaaacacatcccatgctcatggatgggtagaaccagtattgtgaaaatgaccataccactgaaagcaatctacaaattcaatgcaatcctcatcggaataccatcatcattcttcacagaattagaaaaaacaattctaaaattcatatggaactaaaaaagagcccgcatagccaaagcaagactaagcaaaaagaacaaatttagaggcatcacactacctgatttcaaactatactataaggccatagtcaccaaaacagcatggtactggtataaaaacatagaccaatggaacagaatagagaacccagaaatagacctaaatacttacagccaactgatctttgacaaagcaaacaaaaacataaagtggggaaaggacatccttttcaacaaatggtgctgggataattggttagccacatgtaggagaatgaaactggatcctcatctctcaccttatacaaaaatcaactcaatatggattaaggacttaaaacctaggacctgaaactataagaattctagaacattggaaaaacccttctagacattggcttaggcaaggatttcatgaccaagaacccaaaagcaaatgcaataaaaacaaagatgaataactgggacctaattaatgagcttttgcacagcaaaaggaacagtcagcagagtaaacagacaacccacagagtgggagaaaatcttcacaatctatatacatctgacaaaagacgactatccagaatctacaacaaactcaaacaaatcagtaagaaaaaaacaatcccatccaaaagtgggctaaggacacgaatagacaattctcaaaagaaggtatacaaatagccaataaacatatgaaaaaatgctcaacatcactaatgatcagggaaatgcagatcaaagccacagcgcgataccatcttacttctgcaagaatggccataatcaaaagataaaaaaacagtagatgttggagtggatgtggtaacagggaacacttctacactgctgttgggaatgtaaactagtacagctactatggaaaatgatgtggagattccttaaagaactaaaagtagaattaccatttgatccagcaatcacactacggggtttcacccagaggaaaagaagtcattcttcgaaaaagatacttgcacatgcatgtttacagcagcacaattcacaattgcaaaatcacggaagtaacccaaatgcccatcaatgagtggataaagaaactgtgccaaatatatatatatatatacatatgcatacatacacatacacacacacacgtacacgatggaatactgtgcagccatgaaaaggaatgaattaacagcatttgcagtaacctggatgagataggagactattattctaagtgatgtaactcagggatggaaaaccaaacattgtatgttctcactgatacgtgggagctaagctatgaggacgcaaagacataagaatgatacaataaattttggggacttggggtgaagagtgggagggaggcgagggataaaagactacaaatatggtgcagtatatactgcttgggtgatgagtgcaccaaaatctcacaaatcaacactaaagagctcactcacgtaaccacgtaacacccgtaccccaataacttacggaaaaataaataaataaataaaattaatgactgtctaaataaatatacttacttacatttttgaatagttgctcagcaagttccctgacatgctttatcatcttcactgggttattttcttcaactttaattctctctacttcaaaggctaccaactaggaaaaagaatcaaatggcaaaacatcaattccaaaatatgccaaattcaaaaactgtgataatttcatacaatttgcaagccaaaaaaatccaacatatacattatttttaaaacaaaatatttcaggttttggggtttcacctccattctggggttacagggtcaatcaaacccttgaattgtctagtggttcctccctgaggatttagggccctatttcttctagggaaaagtcatttctggaactcagagagaccctgtcattccacaggcctcagtcagagaaattcagacagtcagaaagtgtctaaacatttccttaactcacaaaacatgaaccaaatgttcaagtcaggatgctcagactctagtcctagctctgctgacagtgtgtgatctgggacaaggcacttaaactcctaagcttcagttttctcatctctaaaataagatggaagaacaagatgacccttagactccttctagttctcaaactatctctttattaactaatttactgggagaactgtgtgagtctgtatacttaggggtaaagaaaagaaggctgacagaaaaaaaaaattgtgggggggtaaatagatggatgacaaaaataaaaaggtacaatacaggattcttctaggaactaatagactcactgcataggcatataaaactatggcttacctattctaggctaggataaagaaagactgtcaagggcaaacattcttttcattctaagacatctatctgatggaagtgtgaggacaaggccatgcacaatgcaagctgcctctcaaagcccccataacaccccattgtggtaggctgcctcaggctaagtgaaaacaaggatcactttcccaggagcaaatgctatttttctaccaaagcattcccatgcaaacggccaaagagggtagaatgagaaattatttagttctgatggctcatttttcttaggctcttgactgatacatacatatgattagctggcagtcaagtaacataagtaagacacccaaagtcaccactgtaggccaaacagagaactggatgaacactaaggggtgactcagtaggaaccttggacagagtccttgccttatcattgtttccaatctagactatatttgtacaaacaataaataaataaaaaataagttaccatataaagttagagacaaaatgaagcctaacgcagtcgagtggctctcagagtcaacgactttgggagagtttggaagagatggtgagataagagcagagtatgaagaacagaggagggcactccaagcaagggaaagacctacaaaaatagaggctgtggcaagcaagttttctgcaagtaactaatctcactttttagttgtgatgaagctgtcagaggaagataaatttgaatagaaaagaaagagtatataaaccaatgttactattcataaagcttcaaagactaacaaaatgtaggtgctagaaaagaccttggagagcatctattttaatcccataaaatattatgttatgaattacttagtacagaatctaaaggctgatatgttagtagaatcaataaccaatcatattagatggtaatattagagaatcaatgaccaataattgattagaaaaacttgtccacctcaggatgtttcctaaatcttcatatgctttgtgtttttaattaaagcatctgatgcagtaaacatattctacacagaactaaaatatgtgcctcttctttaaaaattcttacctgtgaatacttcactatctttacaaaaaataaaagatccttctcctctgaaccaaagatatttaagaccttgattcctaccttctctatataaaagaaaatcaccagaagcaaaacatgatcactgccacgattctccaatatcttgggttctaggagtgttgttcttttatagatttcaagaaactttttacatttttggttctaatatagtactctttcaaaaattgaaatgagaataatattcttgttctatccaccagagtgggctgctgtgaatatagagttaaatgataaaaggaaagatgcttttaaaaaagagcacaataaatgcaaaacagcatccttattttgagtcacatctgccctatttctccctttatatggctaattccttgaagatagagacaaaaatttgtcttccatatatttaatgtctcctaagacaggtagagaaatgttgataattgattagtgagaatgccacaaacttaaactatggctctatgattttgatagactaaatgtaactccagtttgaagtaatttcagctatcttagcttcaaattagacctttctccctaaaacactgacaaaagaattactgtattagggcctttaaaaataagacttctatttatacaatcactattaaattttcaaaaatattttaaacaaccattttttaaaatgtaatattttaaaatatgagtagcttttggagtatgagtggttttcggttacatggatgaattacatagtggcgaattctgagattttagtgcactcatcacctgagtagtatacattgttcaattatttaaaattcagttgttcaaaaattatatgtatttccaaggcatcttataattttttgtaatttttataatccacattaaaatatcgagatttgataagcataataaataacattgggattatttaatacctaatttatatttgactatataaatatggaaaatgttactttttacttttaactactagtctaattatgtctataaataatgccttcatttaataagagctatacctcatcaaagagatcacaagatctataaggaggacctctttctgaaacaaaacctgcaaatgccattccactgagtactttagtgaggaaatcattctcgaccaaaccacgctgccccaagaatgctgtctgtgaaaaaagaaaatgtgaaataataatttatcacttggtaacggacaaatggtcaaaacagaaatacaataaaaagatcaaagcctatataaatcccttcatgtataaatatatgctgtcataaaatatatttctctcaaagagagttattctgaaatactacatatattgaaaagaataaaaatgaatctgtctacatgtcaggagaagaaatcagaaattaacattcaattttaaaagaaaaattgatttaaagttaacatattctaagatattatgagttccatattattattaagaactgatatctaaccacacagagattttaaataatcacatttgataaatcaaggtcaaaataaatggctcggaaaaaaaaccaagtagttttattaaattagaatatattttttggacagatacaatatagtactctatcttaccttgtggaaatgtattactggctctgcatgaattcttataagttgcaggcaggatctatatccttggaagagttgtgcaaataatctaaggaaaacggctcgcacctctttatcctaaaaatataagaagaaatgttaggtaatttaactttttaaaaacaaatgaaatatcaagtcaaaaaggtgaaaagggcatatattccaagtcctttgatttttatatccaccaaaacaattacagtcacaaccaaacataagaagaaaaaactctcaagattgtatttaatccagcttttattggaatcacagtttagaactgtaaggaaacttacagattctgttagtcaatgccttacttaattgatcaggaaatgaaggtcaagaatgcttaagtatatgtgttcagctccctgaggttccttattggctacaaagcccactgctaagaaatgcactgagcaaaataaaaaaggggcctctgttatatacgtaaccttttatggcttctaattgaaactattttcatccacagactcttcaaacttgattctctcctataaccaacattctttatatccattcttgtaagcatctcttttgttttgaatccttgtgtggccatttcaatttgatgcttggcacagttttccaggctataatctaggctctgattttctgtcctacacttaactcatgcctcctcagggcaacagtcttagccctagtggcctcttgcccagtgaacttccctgtggctcctccttgagcaggacataaggacagtcagcggcaagtatcctaatttctaatttggggcactttttactctgctgtccatctaactctaacttcacttagcttctttaacaaccctataaataaaaatacagctctctttaacagcattaaatttaaatattaaacttcttaccagcatttttgagtgggataaagctgttcgtggaggaggaaaagcatgatctgctacttccaaatctgggtgtaaaatctaaagcaaaaaagttttgttatgtaaaatatcataatatcaatgaaatctattattgagacattaagatgaaaatgtcagcatatgaattataatatattccctccatgaatacaattcaattagctggggtagttctatatgtactattgtagaaagatctccaagacaaaatattcagttgaaacatgttcggccgggcgcggtggctcacgcctgtaatcccagcactttgggaggctgaggcaggcagatcacgaggtcaggagatcgagaccatcctggctaacacggtgaaaccccatctctactaaaaatacaaaaaaattagccgggcgtggtggtgggcgcctgtagtcccagctacttgggaggctgaggcaggagaatggcgtgaacccgggaggcggagcttgcagtgagccgagattgcgccactgcactccagcctgggcgacagagcgagactccatctcaaaaaaaaaaaaagaaaagaaaacatgttctagaaaaatacacatagtatggcctaatttatttgaaaataaaacaaaataaaccctaaatctatatatgtacatatatatatatatatgaaaatgaaaagttctgaaaaaaatacactaaactataaaatagtagtcatttctggtaagggaataatctaggccagagctatttgtctatatagttgaatttttaaaaacagctgcttgtttttatgtttctaagtgtaattaaaaattactgaggagaggccaggtgcagtggctcacgcctgtaatcccaacactttgggagggcaacgtgggtggatcacttcaggtcaggaatttgaaaccagcctggccaacatggtaaaaccctgtctctactcaaaatacaaaaattagccaggcatggtggcacatgcctgtagtcccagctacttgggagtctgaggcaggagaatagcttgaccctgggaggcagaggttgcagtgagctgagatcgcaccactgcactccagcctgggcgacagttataacaagactctgtctcaaaaaaaaaaaaataaaaattactgaggagacagaaaataagattttgaactttgcagtctagacaggtgaaagtataaaactatgtcacagaagtgcaaaaatatataaagtgcaatacatgaaatgtgtaattaattcaacttagggaagactaaacaaaaaacaaagtaacatttgagttaggctttgaaggaaagcaggttggggagcatctgggaaagaaggacctgtgaaggacttgcacagagaagatgaaattatatcagtatgtagcaaattttcttcttgcagaatcattttcaactactaagatttttgatgctatgctgagaatagaccaaaagactcaaagcaacacttaaaggcaacactaaaatattggcagttcaagtcactgaatcactaccacagtacaaaatatcttagtgtctacaaaataatccatattacacagtttaagtacagtgttgccatttgattataattatttacgaatgaaacaaagcttatatacttgtgtgtcaatgctcccaatcatccatgaaatttagtctctttttggtctagtttgacaatacattatgctcctatttctttttttcttttctttttttttttttattttgagacagagttttgctgttgttgtccaggctggagtgcaacggcgtgatctcggctcactgcgacctccgcctcctgggttcaagtgagcctcctgtctcacctcctgagtagctgggattacaggtgtgcaccaccacacccggctaattttttgtcttttttttttttttggtagagacggggtttcaccatgttggtcaggctggtctcgaactcctgacctcagatgatccgcccgcctcagtcttccaaagtgttgggattacacgcatgagccaccgcacccggccgtatgctcctatttcttattcacagtacattaagtagtatctaatccaccactgtgcttagtaactataacaatacgtatactcagttttaccaaaaaggaattttacacattgatcaaatttggtggcacgggtgttgcaggtttaggtatacgagtatgcagcagaacccttaccaggagccattggcttaagaagtacaatcttaatctttgttaattttgctacttaacccctaaataactattcatatcactagtaagtaaccacacataagatttaatcactgtaggaattctagaaacattaaactttcttcagtcattcaaatactaccttctcagcttttgctatatccatataccatctatgcaattatgtagttaatatttttctttaaattgtctttaaatcaactcaccttctttttttgtttattttgttttttgagatggagtcgagctctgtcacccaggctggagtgcagtggcgcagtcttggctcactgcaacctccgcctcccaggttcatgctattctcctgcctcagcctcctgagtagctgggattacaggcgtgcgccaccacgcccagctaatttttgtatttttagtagagatgggggtttcaccatgttggacaggctggtctcgaactcctgacctcgtgatctgcctgcctcggcctcccaaagtgctgggattacaggcgtgagccaccgcaccctgccaaactcgccttcttaaacccagtattttcttagatgatagttgagcaatgacaggttctatatgctattttaagtacacattataataaaaacataattattaaaataaaaaaggttgaccacatattaccccaaatcatcaccatgcttcattttggcaaacaatcacctagtcatctctgtaaaaacattcaacctacaggtaaagaccaggagacagcctagagataaaaatgtgattctcaataataccaagtggcagaacacagactggaattcaggtatcctgtatcccacactagtgtcttttgcactctatcacatcttgcatttcagattacaaattatataaggaaaagtcagtcttctctaactgttcccatttcatagataccaccatgataacaaaaagactaacacaaatttgaaagttttctgagaataaaatccctcctggtaatcctaggcttctaagtttctatttaagaggggaaaaaatgttttaaatagcccagaataaaatattcttaaagtagactattaaggccttagttctagtgatatcttgaaaagcaatgcagaatttctacagttcaattttctgatcataagcacctaaaaggctatcagtaaaacaaaatactgttttcaaaatttggctaaggtaaaataactgcaaaaaaatttaaatttgtttcaatgagaaaaacccaagccacaagattttttaaagctttatttggcttgaatgtagcatatacttcttctttggtatttctattcatatggcattaagaatggaatgttgggccgggcgcggtggctcacgcctgtaatcccagcactttgggaggccaaagcgggcagatcacgagatcaggagatcgagaccatcctgactaacacagtgaaaccctgtctctactaaaaatacaaaaaattagccgggcgtggtggcgggcgcctgcagtcccagctactcgggaggctgaggcaggagaatggtgtgaacccgggaggcggagcttgcagtgagcccagatcgtgccactgcactccagcctgggcgacagagcaagactccgtctcaaaaaaaaagaatgaattttggacactttatgtatcaatatgacacatctttctgtaataacctgaaagtattggcaagacaatattacagtgttttgtaggtaccaaagaggaatgagatgccaatagggaggttagagaagagaagccaacatctaatgggggatcttaggggaatcagggatttcaaggcagagccttgttttcaaaggtgaatttccaatacctaggacagtactaggtcctgtatgctgaatgaaggaaggaatgtagaacaaatattcagttaggatccaaaatatatgctttagataactacctagtaaatgaagaattctaaatactgtatgagattatgttcatgtttcaaatatatagctctctttaaattaaagtaacaaactgcattgacaaacatttttaattttagctatcttagcttcagatttaaataaagagaaagttactattacaaaaatatgtcataccaaagaaagagctgattgagtctgatgtagaagtggttctgggagggaagagaggtgaatacattcgggaattttaatagtgcctccatccaaatctgctatgattacatctaactgaaagagataaaaaaattaacctataattaccaaaatacatttgttgttaagcaaattatttttcccttgactaattcaaaacgagaagaatcagatgtggaagagactcttgtttgtccatagtagtagaattctgggctaacaagttcccacctaccctgtatttcccaggttcctttgaaattaagtgtggcatgtggctaagattctgccaataaaacatgagaagtgacatgtgttttcctgtccttcaagacaggggatatgtaaagctctcctatgctgtctttccttttcccttagactgaaattattaactggcagcaaaccagccttcagcatacacatgatgacaatgcctgggaggattctgttggagaaacaagaaggaaggaaacttggatcttgagtgacttcatagagcaaactggtctggcataatggaacatctctatggactgctgcatgaatgttcgataacactttattttgtttgagccattgcattttgttctgattttactatatatgctgctgcagcaagcacagaggattgcatttgagacactttattcaagtagtttagtaatattctaaaaaaattagtatttattataagaattaacaattagtatacatcaaaagggtgctgtttagccacttagaaaaagctgatctttagcattttacaaaagtctatttaaaaataacttacataaaagtgtaagagaaaacaaccaagatgagtgaagttgttatattgacaatattatacttcattctaatttattcattacgattttaagaaatttgcatttggcaacacttggtttgtcctacctccagcgactgtttttatttatttggcaacacttggttggtcctacctccagtgactgtatgtatgtatgtatgtatgtatgtatgtatgtatgtatgtatgtatgtatttatttttgagacagagtcttactctcgcccaggctggagtatagtggtgcaatcttgactcactgcaacctccacctcccaggttcaagtgattctcctgcctcaccctcctgagtagctgggattacaggcatgcaccaccacacccagctaattttttgtagttttagtagagacagggtttctccatgttggccagggtggtctcaaactcctgacctcaggtgatccgcctgccttggcctcccgaagtgctaggattacaggtgtgggccaccgtgcctggcctccagtgactgtttatatttagcagaaataaaattatgtacaaaccaggtggatatgcttctaactagtattaattaggttttattaaatgtttattgatttacacatatttttatacagtgataccaaaattaaataggaactaagtatcaacatataaagttagaaagaatgatgactatacgaatgaaagtcctgcttataattataatgttaaataatattttgttagtttaaatgacacctctgatttggttacaactataattacttctttgctggcatttaaaactaaaacagaagaagaattacaaaatcttagggatctgtggatcatagatgctatgcagcctaactttacagtgaagaatttttctcaggctctctgaaaagtgtcacataatcttttccttacactctacttacagtgcttgagagtacactcctcatctcacataaggaaatccattccataaccaggcagttctaattgttggaaacacttttactgggcagaaatctgtttctatagccacttcatccactgattttatttcagccttttagagttacaaaaaatgaatctcaacccttcttctatgacagtaacttaaatacttacttttacctatcaaatagtatcagattattacctgagaaaatttccttaggcccttacagaacatagtttctaaatacttgataatcctggatgtccttttctgatgtgctttattttgttacagtccctcataaagtgtgatacacagaactaaatgaattattccagaactggcttgaatatagagtatacttttgcttcttctattcatatggcattaagaatacaaaaatttcgtggaagctcataccaaacttctgttccactaaaactcttcactcttttgcatatgctttctgctttgttagttatcaggaatttggtatcaagacacgtctcacttcaaaatataaaacaattatgcactaatatcaaaagtataaatagaattttatcttttgtcatatgtaagatgaataataaagataaacaatgtaccaaaagagggatatttaaaaatattaataaattcctttataaaacctcctatacttgctatatggcaaaattaatatacagacttttcaatgatatttttcttctatccaatcttttctactggaaatgctacagatctgaaaatagtgatgagttgaaatgttataggacccaaagaaatatgataaacttctggactcaataactggaaactttaaagatgaatacttacaagttcatggacatcagttttaaagacagaatgtactccaataatgaaaggcgttggggaacttagaacttccagtagctgagccgggagaatagggatataaggataactggaaataataaaaatatgcgtcaaatatatttttctttaacataaacatatcttctttcatctttatgctgtgttaagttttatattacctatgtttagaaattatcaataatgttttcatgctttttaatactaaaattttggaaaaaatgatttaaaaatcttcatgtgaaagatacaatcagatataagacataaaataaatggaatccaagcctgcttccttaacctttgtttcttctaggcaagcagtctctttaggtcttctagtactgtttgaaagcatttttccttacatagaaacccgacattagacagtaacactgactctctgatagggcctcccctctcagtatgaggcaatgatttatctatacaaaacaagcattcaaattccactttctatacttgatttttgcattcaataagaatggcaaaaaaaaggggggggccaataattaccttatctaaaaagttaagaaaagcacctaaattaaaaataaattttttttttttttgagatggagtctcacgctgtcgcccaggctggagtgtagtggtgcgatctcggctcactgcaagctccgcctccagggttcacaccattctcctgccttagcctccccagtagctgggactacaggcgcctgccaccatgcccggctagctttttctatttttttagtacagacggggtttcaccgtgttagccaggatggtatggatctcttgacctcgtgatccacccgcctcggcctaccaaagtgctgggattacaggtgtgagccactgcgcctggccaaaaaaatttttttaaagaaattctggagtctaaaattttatctagtttatatgaactaatttcccagatgttatgattatcaattgattaaacagtatattagaggtataatattctagttacagcactattagtcatcactgtttagattttattttgttttttagtttttattaggaaaaaaattttaacatatcccataaaaaaaacagaggaaaaaattacaacgaagccctgcagtaattgtcaactttgagaattaccagtgcacggctacatatatatttctacccactttttttctctctactgtattattctcaagcaaataccagatgtcatattgtttacccatataatacacttcagtgggtatctaagagagataagagctttttattaatagaatctctatcattataacttctaaaaattaataattctttaatatcaaatagcattgactagacatttatgccaattgtgttaaaagttgctgacaatactattcaaattaaatatttttacactaatcaacattcagtaatggacaacttggaaagtctcaaattctagactagattttatcagaactatgactcatataacagcataactttgtaaaatatccctatgtggttcaaaaccattgtgccataacattatgacttatcaacgataagtgatatgtagtttaggaataaataaaattaacaaatgaaaacctcacctatatttaagaggaaacattaaagattccagggctctacaagcatcactaagtctctggaaacttgcagaatggaagagaaccttattttctgtgaggactgcacaaaagaggctgaggacattttgaattcctgaaaacataagagcaaggacttacaaatgcatttaattttatatgtgttgtcaacaatcatagacagtatacacggaaagaaaaagccagtaattttggactctctgaaggaaaatacttggttaaactgtaaattccatataatctatgagtatttgttttcccaaactttcagttttgcctttattcttcaaatcaggtaacactcattgaacatattagttgtttggaaacactattaccttcttttcaatttcatctctaaggcctgtatttaggttcctgttttagaatgctagcattgttctaaaaactaacccctgcagagtctgtttgtctgacgttaataataccacaccagctttgttgttgaaatttgcctactatatcttttctcatcttttaatttcaacctttctctacttcttgtaaacagcatacacaaatgctccgcaatttaatgatagggttacgtcctaataaacccattgtaaagttgaaaaatcttaaattgaacataaatcagagactgtaactgaaatatttttaatccagtctgacaacttttgtcttttaactatttcatttaatccatctatacttattgtaattattgagatatacactatatatagagataaatgtggtatcttattttatgctttttctttttcttttttctttttttttttttgagacggagccttgctctgtcatcgaggttggagtgcagtggcacgatctcagctcactgcaagctctgcctcccgggttcatgacattctcctgcctcagcctcctgagtagctgggattacaggcgcccgccaccatgcccagctaattttttctatttttagtagagacggggtttcaccgtgttaagcaggatggtcttgctctcctgacttggtgatacacctgcctcggcctcccaaagtgctgggattacaggtgtgagccaccgcgcctggcctggtttttattttttctatcttctcttttttccttcttttcaatttctcctgtctcttctttcatcccctctgttagtatggtatttataaactctttttctatttttttagtggcaactctagaaaatacgatatacatacttatgaaattgaagttatatatatcatttcttattttctcctgtttattactgaaccaaattatctttctttatatcacttcaactttaatcatacacacccggtaaagcaagagtccccatttgttttctcaaggtaaaatactatattttccctttatcatagcttatttcttcatgtgacatgcaaatttccttagtctattattaattgctattccctcttatcacttccaacttatcccatgtgatacatcagaatttttagttcagattttaatcttcattcattttcactaatgtaatagtttcgtaagtgattttcctaatccagtccttattcccttcaaatctaccctccagatagtttctagaataatggaaaaaaactaaataatgattaaagaaatctaaatacaattttcaagtggtttttaaaattcatattaaatccacaagaataaatgctacaaattttgcaaaaaatattcttttggctttaacatgaattttaaaaacccactaaggttttggtacacttaaacaacagtggaaatgaatgagctagtattgtatgtattatcatgactaactctcccaagtataatattgagtgagggtagtaaggtgcacaatgattatatagctgtgaaaagaaaataaatctcaggacccccaaaccaccaagccaaagggaagtcaagctaggaactgcaccaggaaaaccaacctccattttattcctaagtaagatagctacaaaaattaaaaaaaaaaaaaaaaaaaaacaaactacatacctcccatacctccctcacaacctgcccacaaggaaattccttgtggacaaaggacagacaaaactcaaagtcatccctgtactcctgtgagacaaatgcatatctgatttcttcctctgccctattgtttcactaagccagactaaagcttaagtgactattcctctatcttcctctcacatgtaaattgtgtattcagtaaaaggctaatcagagactcaaaagaatgcaaccttttgtctcttatatacctatgacctggaagccccctcccctgctttgagctgtcccgtctttccagacccaaccaatgtacatcttatgcatattgactgatgtctcactgttacagcaggtagctagccagacatgagcagggaaggagaggatcccccacccccatgccaccaccaggaatgtcaggcaaccatcaggtgatggtcaggtgattattaaactgtctctctaaaataataattggtcatagctgatgccacagaaaggcagtcttccaacagacagaaacatcagaaactggtgatcagcagcttcctgataaaatctcaggagttggcgagcgggctcatgcctgtgtagttaagaggcaaaatggcagagtttaactggtatatgaccctctaggaacatttggactggtaaaggaagaaagcctccagtgagcatgcgtacaattccagtaaacacactgcacatgtgccccctaccaaatgctgacaggcctttgtgcatgcggagtgcccaccccaagggaagaatctggggaggagagatgcaagaccccggacacatgacaacatataaaatcccgagtcaaagctcaaacagtgcacttgatctctcaagttgtctgcttggccctcttccaagtgtactttacttcctttcattcctgctctaatactttaaaataaactttcactcctgctctaaaatttgccttggtctctcactctgccttatgctccttggttgaattctttcttctgaagaagcaagaattgagattgctgcagacctctatggatttgctgtcggtaacatactttggtgctgtgatttggatacattccctaatgttaacatactttggtgccacgtgactcaaatatgcttcctcagtggtaagacatctctatgcctcaacttctttggctggaggtgtttaacccctgtacacagtttcgtttgctcttttcattcttctgcttactaaccaacccccagaacaattcttctcggccacagtggctctgttcctcaagctcatctctcagctcctgctgatgtacggtagctcacaggggtaggaaggaccttggagtccttcccaggtaagatcattgacctgagacacaatggctctcctagacaagaggttcatgagagtggtagggctaaagcctaaaaccatgcaatgtctggggtttcctctgctttttcaactcaaattggctcttttccaaaaacccacaccacctattctcctgttttctctgtatgtattctgaaatggccttgtacaccctccggaccgtccacctcgaggcaagtcagcctcttttgctttcactttgcatgccatgtaactgttatttgtacaccctcagctcttgctgaatttgtgcagcagcaaaaacatgggctcccttgtggctatctagagacttaacactagtttttaccttaccagctcagatgacctctaatcctgcctctgtctgttggtacattgccaggacagacactaattggatccccagtcagctccttatgacttaccatatgctttttgttcctgttacggtccagggctgagttttccggtggcttttgaagtagttttccacccacatagggcctcattctagccctttaaggaccccacttacttgctttttttgagttagcaccccttcgggaggaggggaaattcttcctttcccatttgtgagttcctacatcaagccctaagtcctccagaggttaccactttatgttaagaagacaaataaatgttaccctctcaaatccaagggatgctgtttttggaagcataagaaggctttccatgattattcctctggcttcctcccacttcctcctggagcttccatttctctaatcacttccatgcccttctcaatattgatcaaaatcttcaaggtcatatttgaagggagggaagttcagcccccttgcagcagttagctgaaaatcaagcttcttgtctagttagagaacaaaggaaatgggaatctgagaaaagggataatcattttgttgcaagaatgctccaagttgagagtcactggaaggtcatggaggcaagaatataggatggcccaaggccgtcggcacaagagacccatacgacagacatgaaggctggtctcgggttaacagattatcattataacagagatgaaggcaaggttaagggtacgtggtaagaccagttcattctggaaccgcacggatgaacaggagagggctctctgttctctctggtatctcctctgtgaaaagggcgtaccgaagttaagggtacatggtaagatcagctcattccagaaccctaaggacaaataggggatgccctattcaggataataggaagagaagacgctttcttttttctttttttctcatctattctctcttcacagatgggtaactgcatcttcataccacagaacacgcccctcagatgcattctcaagaactgggaaaagtttgactccaaaaccctaaaaagggaaaggctaatatttttctgtaacacagactgaattgaatacaagctccacgaccaggaatcttggacagaaaaccaaaattttaatatgatctatcaactagatttactttgccgccagcagggaatatggatagaaatcccctatgtacaggccttcatagccctatgaaacaaccctgacctttgttgggcttgtaaaatggatctagtgatgatagctgccatagtcaggcagccccctctggctggttcgggacactccttattgggtttaccctggtttcaagccccagaggagcaaaagatgacggctcaaaccccactgccccttctacctcattatattcaagtctcccaggcccggagcccctccatatccagggctatcctctggacaccaccctcttaggtcacgcccccttcaagaggtcagtagccccagtggacccactagaaaccagactccattcactatgtaaggcctgagccaaattacaacagaactatgggactttatggaggaccctgacaaatacatcaaagggttctgtaaactgggattaacatttgaactcacttggagggatttctcagtcatactagggcaaattctgtctaagggagaaagtgattccattatggaggtggcccaacaatttgcaaatccaatgcatatgactgacccgggtggctaccctgtaggagccatcacagttcctccggttgactccaattgggattacaatacccagggaggtatatggggaagaaaccgcatgttcctctggtagaagggataaaagctagcagaacaaaggctgtgaactataatacaatggccttaatagatcaaggccctcttgaaaaccccatcactttcacagagaggctacaagaggccctagtgaaacatactaacctagacccagagacatcagaagggcaactggtcctacaggaccgtttcctaactcaggcagccccagatattcagaggaaactccaaaagctagcactgggccccaatacccctatgcctgatgttctcaaaacagttgccttggtcttttacatcaaggaccagaaggaagaagaaagggctcaggaaaaggagaggcaaacggaaaagtggcagctccaactattggctgtcttacaagtccaccagctccctccaatttgccctaggaatatcttcccaaataattgcattggtatgagaagccaggccactggaaggccaactgcatcaatgggacagatgggaaaaagccttgcatggcttgccccctccaccacaagcttggcaactggaaataggactgccctgagggctggagggctcctgggagagaatcctttgtcttgagctgaggggggcctacagtccagctggctcccagatcaaacatcactattgaagggacagagccaaggaatgctttgcatgtggcaggtaggactataagttttcttttggacactggagcagccttctcaatgcttacctcttttcctgggcaattatcctccaaatcctgccagataatggggataaatgcggtgcacataaccaggaggtttactcctcctttgtgctgcctatctgggggaactgtcttttctcactcatttttagtgttgctagaatgtcccatagcccttttgggtagagatattttatttagactagaggctccagggcagacatcccctttttgaactgcgatcttatgcctcaaggaaaccacacacaagggtgaactgcccatggactgtctcattaatccagaggtctggatatgttcctattgtcatatataacatttaaatatgttacaacggcaaaacagttaaacttattgctttctatatatttttatttattatactttaagttctgggatacatgtgcagaacgtgaaggtttgccaaataggtatacctgtgccatggtggtttgctgcacccatcaacctgtcatctacattaggtatttctcctaatgctgtcccttccctaccctccccaccccctgacaggccctggtgtgtgatgttcccctccctgtgtccatgtgttctcattgttcaactcccacttatgagtgagaacatgcggtgtttggttttctgttcctgtattagtttgctgagaatgatggtttccagcttcatccatgtctctgcaaaggacatgaactcatccttttttatagctgcatagtattccatggtgtatatgtgccacattttctttatccagtctatcattgatggacatttgggtgggttccaagtctttgctattgtgaacagtgctgcaataaacatacgtgtgcatgtgtctttacagaatgatttataatcctttggctatatacccagtaatgggattgctgggtcaaatggtatttctggttctagatactggaggatcatcacactgtcttccacaatggttgaactaatttacactcccaacaagagtgtaaaagaattcctatttttccacatcctctccagcatctgttgtttcctttttaatgactgccattgtagctggcatgacatggtatctcattgtggttttgatttgcgtttctctgatgatcagtgatgatgagctttttttcatgtttcttggacacataaatgccttcctttgagaagtgtctgttcatatctttcacccactttttgatgaggttgtttttttcttgtaaatttgagttccttgtagattctggatattagccctttgtcagatggatagattggaaatattttctcgcattctgtaggttgcctgtcactctgctgatagtttcttttgctgtgaagaagctctttagtttaattagatcccatttgtctattttggtttttgttgccattgcttttggtgttttagacatgaagtctttgcccatgcctatgtattggtattgcctagatcttcttctagggttttaatggttttaagtcttacatttaagtttttaaggcatcttgagttaatttttttaaaaggtttaagaaaggggttgagtttcagttttttgcatatggctagccagttttcccaacaccatttattaaatagggaatccttcctccattgcttgtttttgtcaggtttgtcaaagatcagatggttgtagatgtatggtgttatttctgaggcctctgttctgtcccattggtctatgtatctgttttggtaccagtaccatgctgttttggttactgtagtcttgtagtatagtttgaggtcaggtagcatgatgtctccagctttgttctttttgcttaggactgtcttggctatacaggctcttctttggtttcatttgaaatttaaagtagttttttctaattttctgaaaaaagtcaatggtagcttgatggggatagcattgaatctataaattactttgggcagtatggccattttcacgatattgattcttcctatccattagcatggaatgtttttccatttgtttttgtcctctcctatgtccttgagcagtggtttgtagttctccttgaagaggtccttcacatcccttgtaagttgtattcctaggtattttattctctttgtaacaattgtgaatgggagttcactcatgatttggctgtttgtctattagtggtgtataggaatgcttgagattcctttatgcttttttaaaaactaagagaagaaataaaaaaatacacatatagtctatttacccacagatttcccatttctagtgttgtttgttcgtgtgaaatcgaattattaactagtctctttttcctgcagtcttaaggatttccttttgtttttattttttattgtttttttgagacatagtctcactccatcacccaggctggagtatagtggtgcgatcttggctcactgcaacctctgcctcccaggtttaaatgatccttccaccttagcctctcaagtagctgggaccataggtgtacaccaccacatctggataatttttgtatttctctgtaaacatggggtttcgccatgttggttgtgaactcctgggctcaagtgatccacccacctcagcctcccaaagtgttaggatttcaggcgtgagccaccacgcctggccttccttttgtatttcttatagagcaggtctactagcgataaatctgtttttgtttacttggaaatgtcttcattttatctttgtttctgaaagacagttttgccagtgacagaattcttgtttggtatttttttctttcagtgcttttaatatgtcacatcaatgccttctggctcccgttctttctgttgagagacccgctgcaataatattatagttctattgattcatatagatgaattattttctcttgctgttctcaagggtttgcctttcaccagtttcacaatcatgctgtgtctacatggggatttttttactgttaacttgggcttcattgtgcttcttgggtctacaggttaatgatttcaacaaattttgctaagtttttgagcattatttcttcaaatacgtttttctaatcacccccatatgcatccaatggagatgctctgtacctaaaaggtattattgtctcaaaggtctctgagaatctgttatttttatttcaatctttttctctatgttttttatattggatcatttctattggtctttcaccaaattttattgatttttatttctgacatctcaaatgtgctgttaagctcagctagtgaattttttgtttcagttatttattttgagaaagggtcttactctgttgctcaggctgtagtgcagtggcataatcacagctcactgcagccccagccttctgggctcaagcgatcctcctacctcagcttcctgcatagctgggactaaggggtgcaccatcacacctggctagttttttattttgtagagatgagttctcactatgtttctcaggccggtcctgaacttctgggcttaagagctcctcctgcctcagcctcccaaagtactgggattacaggtatgagccacgatgcctggcctgtttcagttatcatactgttcaatctataatatctatttggctctttttcagtttttacttcactactgaaattgcctaggtttttgaccactgtcattatattttgtcttaattctttcaatatggctaccattaattcttttagcatatttataacagctgatttaaagtccttatctgctaaatccagtatgtgcgctcaaagtcagttaatactatttttttttcccctgagtatgggttacacttcactgtttgaatgcctcttgctttttggtaaaaattggacattataaataatatactgcactaaatttgaattatatttttttcctgaaagcttttttttttctttgagagggtgctcactgctttaagctgcaaaatctgcttgtaatgttaggctgctgatgtctggtttaaaattttttatttttatggtttagcttggcttcctaggggttatccctgtgtttgcatggttcacttggtcagtccataatttgggcagaggttgtactcaaataccttgagccaataaagcttctacgtactgctgaccaattttgcatgggttggagcacgttcatagtttagccagattttaagtatgctttcagtttcagacatgtgcatagtttcccaggcagccaggcatgtatagagacattgtctagttcttctaagactttctcctcttcacaatttctctgttaaatttctggctgatgtgccactagccccaactatgactgtaattcagacaggcatctgacgtttttctcctttcatctcctactggtttcaatacttttaccgataatgatgccatgggttttagccctccatcccaaataaattccactccatctggtagcaaagctggttttctacccagccctactctgccactaccagtctcactgacaaagctgggatgtaggggagagggggcaaccaccagataagaatgctgcagactcctgctgtttttacacaaagttctagcatgaataaatgtttccaaatttgtcatttgcttttggtcaatttccagagccctgaaattgttgtattcaacaactttgtctagtttatactggttctttgggggaaaggatttgctaaactctttgtactgtctttggtgatgttaattttgtctcctaaattttgtccaatgctgtccaatttctccaatgaatacttattatttttcctgcaactaaaaagcaatctgtatcaagacactttaagaccacgtaaatatctcatctctcaccaaaatgcctggctagatttagcatctactgataatttctgcctgaatagatctttactataatgattataattttccaaatgcagcactcactctgtatttcccagtcagcacttggcattctacatagcagagtcctccttttcctctacttacttgctcattcattcattcattcattatcagtgtggactcataaatatctactttttcctaacagtctgtaagtcactactgtccttaatttttctggtgctaaacatgtcctagatttatgcagtaggagccctttaacttagttcctgtgtccttgagacagagctcttttatttttccaggctcatattgtacttaccctgtcctagccctagtccaaccatttctcctaagagtcctggttctctttggtgagaaatggtatcaaagaccaaaattttaggtgttagggcatgtgttagatcatttctactggggtgactttgcttctaggccacttttgcctatagatggagctaggaaatatatgcatgtacatatatacatacacatacatacatgagaacatatacatgcatatgtatttgagaaatcctgagtctatgccattacttttaattccattccatccccacagggtatccctcactatcccaattcatatttgtatgttccttcttccactgagaatgctggaacctaataacatcaacatacttattcatttgctaaatcctgtattacacataaaagagcttcagaattgtttcagccatttcaactaaaaaaaaaaaaaaaaaaaaaaacgaaaatggagttcactatttgtttgcaattctcttcccaaaactgtccaaagctgagtttgtacagtcaaatactcataagttactaaagtaacttagttttttttccctcttcagtgtggttacattatttgaatgacagtagagtttgtttacatatgcttttaattttaaggtaatattttctttcctttcttcttatcctaattgaattttttaatatatgtaagacacaaatatgctaccagaagtcaaaataatacaagaagatacacttagggaagtgtcattccctccctcaattaatagtactgtaccaggcctggtgcagtggctcatgcctgtaatcccagcactttgggaggctgaggtaggtagatcgcttgagcccaggagtttgagaccagcctgggtaacacagtgaaatcccgtctttactaaaaaatacaaaaattagccaggcatggtggtgtgtgcccatagtttcagctacttgggtggacgctgacgtaggaggactgcctgagcccaggaggtcgaggctacagtgagctgagtttgcaccactgcactccagcctgggcaacaaagcaagacgcaccctgtctcaataataataataataaaataataatactgtatcaatgtcagttcctggtatccataatgtactatgattatgtaaaatattgttataggaaggtgggtactgcatacatagggactccggatgaatttagttatttcttgtgagtcaaactatttaaaataaagagtgatactttttaaagtctgtggatgtattagttttctatggttgctataacaaagtaccacaaatttggtggcttaaaacaagacaaatttattattttactgttgtggaagtcctgtgatcaaattttccagcttctggtgacttctcacgttccttgtcttgtggtttccttctatcttcaaagttgactatgagcagtcatactatattactctgaaggtaaatcttttgccaccctattaatgactcctgaggttatcgtggtccacctggggtgggagcttcctaaagggactgacccttgaggtagattttgacagagatgcattagttaaggagaaaagaaaagcatagcattcaaagctgacagaagagtgaggaagcaaatggcattaacagacctacaagtaatttggccaaagacaaatttatgaagaatctgtatgtcatgtcaagtctagtctttttaaatgaagactctggggaaaaacttgtccctctttgcttttttttttgagacggagtctcactctgtcaccaggctgtagtgcaatggcacgatttcggctcactgcaacctctgcctcccgggttcagcaattctcctgcctcaggtgccccccatcactccagctaatttttgtatttttagtagagatggggtcccaccttgttgtccaggctggtcttgaactcctgatctcaggtgatcgacccgcctcggcctcccaaagtgctgagattacaggcatgagccaccatgcctggcccccaccttgctcttatctgaacactctgccctatcccacaaaaaaaggataaccgatttacaagtagttcatcagaaaataatattcataatcagtatcatttagtatcagataaattgtgaagaagggaggcctgcagttgtaaggaactttacgttactcatattagtaaaaacaatcagttgatattgtcaagggaggcaatgctatactatatttactgagaggatatatgtctcataatgtagaaatgagataggaacaatattctagtgcttaaagggtaagtttttcattatccagaaaattaatagtataatacaaaacaatttacccaagcctaattgaaatactacttaaattctttattcttaaatgtcacatgctttcttaagttttacattattattattattattattgtttttgagatggagtctcgctctgtcgcccagtctggagtgtagtggtgcgatctcagctcactgcaagctccgcctcttgggttcacgccattctcctgcctcagcctcccgagtagctgggactgcagacacgggccaccatgcccggctaattttttgtatttttagtagagatgggatttcaccgtgttagccaggatggtctcgatctcctgacctcgtgagctgcccgcctcggcctcccaaagtgctgagattacaggcgtgagccaccgtgcctggcaagttttacataattaataatctcaaatattttaaattacattaatgatttttattcctatgtagcagtgtttgttgctgtgttcacagttacatagctattgagaaatccagtttcttttaattttgtaagtcaaaatcagttttctatataactgaattgtctcaccttctgtagcccaacatccattcaaagctgcacaataacacgggagaagaaaatatgaaaaacagacatgccagtgataattactagcgatttcactacaatgatacatatacatcctgttgattattcaaagagtaaaacattctgaaagatggcttcctgatctcaattttcttgaaaggttagagttctaaaattcattgcaccacatgttaacaaatgtatttgtttcttttttggggaaagaaaaaaagaactttctccagactcctgcattctctgaataataatgatatgttacacaaatagaagactatgtctcagctttcaaatggataaacagtggaactgaagaccatgtttcaaaacagaatatagttcaaaaagccctgcacaatttattatagttctttctggccaacccacaacggggaaaacagtatagttctggtcacagcttaatgtaagtcatgaaaaaggaggtttctcattcactgaaccagtatttattgtgtactatactccagacactagaatatagcagtgaataaagacaatatccttaacttcatggattaactaaaactttatataaagtttcaaatttatcactgagaggtaatgtttactatctgttacaaatttagcattatttccacatatgatagatatggcaagtattctaagtaaaaaagtaaaaagtgtggtaaattgggcatctgaaaggaggtgtagtttagtccttatgaacacagactcaaccccctgagtatgacatgaattaaatatattttacacacacaaatagagcttagcaatgtgggagactaaatataagaagtcaattaccaaacacatatgactaaaaataattcaaatacataaaaggccaattcaaccaaaactgtgtaaaaaggtgcagcatctttacttccttcttgaacattctaattgtttttctagctctgaggtaataacatcagatttttccaaccttcaatgacccaaattcctagactatgtctgttctgcttgacttggtttttatctacttttaattctaaatttaagaattaggaagcaaaaggagccttgtgagtagagcagcaagcagtggggaagaagaacagagaataactggagaattatgcaaggaacaaataagagggaactgtcctggcagaaacaactcttttaattcaaacttcctcctttcttttcccctttcttcccttctgccactattacattattactgaactactgagatatatcatcaatcataaaattctagggatggatataaagaaatatgagacaggctcttaggagctcacagttcagtgaagacgaaagactggtaaataaacggttaaaacataaaataatagagctatgtatcaaatgttacagagcacaggaaaaaaaaaggtacttcatcctgccaccatttggaagctatgtacttaaatgttggagtagccatattttataaaaatattaaccactaaaatgctgaaagagcaaacagaaattttagacaagagaactttgtgacaaggaagaacgatacctaatgactctcttgccttagagcatttacattctttatagataattcaatgcaaagatagagctatttaatattagcatctacgtgccaaaaaaggacaatgggcaggacagttttgaaccaggatccttctgaactttcctcagattatatcatgtagcaactactttcttcacatgtgatttgagcaagcatagtacaccagtcaacaaggactcaattggtcaatgactgtcagtctttgatatttttacaacggtttctttatagaactagcataaatatttaatttttaattttgaaatgaaaagcaatcagtttcttaataacattctgactatttcctaaaaccctgttctcaggcttcaccaaacatcttactattccatgagggcctttcataatttcctataatgctaaatatgcttcttcttctagaatgcccttattttacttttctagcaagtaagagtttgctcttggtatctctattattgtgctaattatattctactatagttttaaaacgatacctgtttttccattaggctaaaagtacatctggggtaagagctgtgatttgttcatctttatatccccagtgactaactcaggagctggcacataataatggctttgtaaacattttgtgaaaaaaaacatacttctaccatcatataagcagaagggcattacgggaactttcttatagactcccatgccatttattagaaagaaattacattggaacagttttcgttagagatccttaggcctctgaaggtaagcacatggtacacgtggtaagcagttccttcagaaaagtgccccagagtgggctagcaaggagatttaatttgcttcaaatccccaaagaacatagctgatattcaactgtcaaaaaataattaatcatagatacagtaaaatagggcacaagatgccattattagtaatagtttaaaatcttgtgtactcaaatttgcaaactatgtttttatgataggagaggaaatatattttctttaaatttttttttaaccctgataagtttgttgttgggacagacccttatgacaaaagacagattaatatgagaaaactaagcaagcttccttcaaggtcaaacattgaaaaaaaaaagacgacttcattttttccccttataagtgagaataagattaaaacaagtaataatgctatatgaataagctgagaaaactaagacagaaacatgatctgaggccctagatgctgatcatttcagtaaaaaggataaaaatcatcctacaattgatgcattaattggatggttcagcaatttaccaatcagtattttcttttaaagaaaacatttttacacatcctaagctttcatttttacctctggcatcttttcatctttatgttttaggaacgtaagttatttttaaggctcctacaaatgttcttattgttatagtagatattcagacagacataagcagagcaggagaacctccttcccctgcccaaccccaaccaggaatgtcaggcgaccatcaggtgatggtcaggtaagttgttaaactctctctctaaaataataattggtcacagtggtgccagggaagggcagtttcccaagatagaaatacctgaaattggtgatcggcagcttcctgataagagctcaggagttgggtgagtgagctcacgcaggtgcagtaagaggcaaaatggcagagtttaactgctatatgaccttcctctaggaacactggattggtaaagaaaaaatgcctaaagtgagcatgtgtacaactccagtaaacacactgcacgtgaagcccctcccaggtgctagcaggccactgtgtatgcagagagcctacctcaagggaagaatcaggggaggagaaatgcaaccacccagaagcatgccaacctataaaatcccaagtcgaaaagccaaactgtgcacttgctctctcaagttgcccgcttggcccaattccaagtgtactttacttccttttgttctagctctaaagctttttaataaactttcactcctgctctaaaacttgccttggtctctcactctgccttaggccccttggctgaattttttcttctgaggaggcaacaatttttgctgcagactcctatgggttcactgccagtaacattatcacttcaaaaataatcacatagtatcacagagagaagtttttccagggaaagacaaaagtgagactaccaaaggttttccattaaagcattttaaaactgaaacaacttgctgaatagcaaggaatggctacagtcaacattttaataacttttatgtacaaagtaagaataatatttgtaagacaaactgaacaaaaacttttttaagaactttaaaaaaaaaccctatatttaatatcagagatcatcgatggagacatactgacccatcaatagctaataaaaaactggccaaagttaaccatggacaagtaaaaagaaagcatgcatagaaaaaggtacaaacacaaatgatacaagattaatgtggtttaactgtggaaacaaagtgttgatagctgatggcccaggatcattttagtcagttttcaaaaatgcctattaaagagtatactgtgaaaactgttggatacattttctaaaactagtacatgttctagtaaaatccaaattacaggtgaacagacatgacaaaagatgtcaagagcattttacaagattatttggggcagggagggacacccaagtttaaacgggtatggattagattaaaatatcacagggtctataaaaaccagttcctgtgaatacaaacttattaacattaaaaatcccagcattgttagtacacttaaaacactaatcctcaggtaaacaaaaatagttcacataggctgccaaaaaaacaaaaaaaacaaaaaaaccaaaaaccaaataaacacaagacagtaaacaagagatgaaggcgatcaagaggaaattgtagggagtgaagcttggaatggcagagtccatataattatttcagaaaaacacagagaccttttaaactgtgaaaaacaaattcattatcataacaattcttagagagaagaacaaaggaaatgctatcattacatttagacctttcacaggaaaactagtcaaggttacaaaaggatcttatagtcttatctgcttcctgtctgtgctttgtaaaatccgctaccaccactacccccaacccagctcgtgaactctgataatggcctaatattggcctttgacaaagtccaaacaaaatgacaggtgataagagaatgcctttatatagaattatcaccaccatgtgctttggaaacaacaactctgcacactgcactgcatctttctttctgctttgcttccttatcttttccccattctttcccagaaaaaagtgaatttagaacatgcaagcaaaagataatgaagctgaaaatactagagtaaaataaaataataaaatttgatcttcaaatgaccaattattatgtattccggcacacttcatcagtacacagaaaaatctacaatatggttaccacttcctcatagctagtgcattctttcatttattcaataaacattgatgccttttgtacctgaggcattatgccagatatagagtacacaagaataataagacatgtaagttttaggaaaaacttcttataaacaaacaggggaaaaaagcataggatagaatttctgtaacgtccctgaagatattccagaatcaatacacatcagccctggactgcctacctgtatgtagactttttgttatgtgagaaggataaaatctgtattttgcttaaatacatatttttaaggttttaaaaatatattagttatgcacataaaggacataaataattttacaagttaaaaaaatctttttattataaaacacagatatagaaaaccacacaaatcaaatgtatggcttaataaattatcttaaaaataccacccacatcaagaaagagaactttcccagcaaaagtaaaagcccctggaagccccttttatgtacccacccccccatcataatctcctctctactgccaagagtaaccatgcttttatttaatatttatccactttcctgatttttttctataggcagtttttatcacccaaaagtacatccgtagacactatagtttagtctcactctattaaaaagttggatgtcttttaaatctctttcaatctcgaggttgaggaacctctagattgttaaagaacctgggacatttgactaagagagtttccaacagcctgcattttggtaattacattctcttggtgcagtttaatgtgttcctctattttctacattttctgtgatcagactcaggtttaatccctttggcaaaacaataagtagtgtttggtaaggttataacggcacataatacttgcttgtttttctttctgtggtaacagctgttgatacttagatcttggttcattgaggattgcaaaatgatactctatttccatcatttctttcatctttattaattagaagactttctaaaaaagataattgccctcaactactattggttatcatttttttctttattgataaattttcaagataaattgttctttatcatattctgaggtaggtgacaatccctttttaatattatgaattcatggatcttaaaatatttgctgggtttcaaccaactgcaattattgtaatttttgaagctcaaattctatcatcttagatcagttgtgagcctcttcaagatggctcctgagttcttttaacaagcctctaacagtaacattttttcttaattctcataccataaattccccattttaaagtatacaattcagtggtttttagtgtagtcacgaggttgtacaagcatcattagtatccaattgcagaagaatttcattcctcaaaagaaaccccacacccactggcagttatttctcacggccctatccctcgagccccttataatcactaatctgttttgcccctatgtgtttgcctattttggacattccacataaacacaatcatataatatacggtttttgtgcctggtttcttttacttagcatgtttccaagattcacccaggttgtagcacgtatcaatacttcattccattttacggctgaataattttccattgtgcggatatatcaaaatttgtttatccattcatcagctgaatgacatttggattgcttccactttctgactcttataaataatgctgctatgaacattcacatacaagttttggtgtgaatatatgtttttctttttttttaagaatctgatacattttgacttatgtacatacttataaaaccatcaccacaatcaagactgtatacacaaatatcatccagaaagtttcctcatgtccctttgtaatctcgctcttcctatccatgaaacaaccagtgacctgtttccatcaccatagattagaccacattttttagaactttagagaaaccgaatcatgccgtatataatttttctgacatttttcattcaaaataattattttcaggttaatctatgttgcgtgtatcagccattcatttttcatttagcttagtagtattacattgtatgaacataccacagatgctttatccatttccataatcaattatcctttaccactggtggacactgagtttgtctccagtttttcactaccataaataaaatggctatgaacattcatatacaaatatttttatgaacatttttaaacttaaaatagtcaaactgtgttccaagatagtggtaccatttcatattcctattagccatgaataagaggtctaattcattcacatttttaccagtactcagggaagcactctgaagtctcaacacaaaatgctcctcccacttctcgccaaggttgataagcctcaagttgtgtgccttcttccaatcacaccaagctgtgcaggtcacagcaagcatctccccaaaccccttctttgttctcagccccccagacatccaaactatgtcagctcctgcttgtgcttccaaagaggcaacacagaaacaagtcccttaggcagcttcctcaacagccagaatttgggatgcaagctccactcttccctcctccctgtacccccaagcctgagagagttgaggaaggggctgatacaggtaacataaaattgctctatttacacatttcaatgctgctattctctgctttgtgcaagtctgaggtactgtaatttcttgactagaatctggaattgtcatgcagggatttttgtcagtaaatctttgttaaatcagtgtttctgtcacggagggagggctggaatttcctattcctctatctgattaatgtcactcccaaattctcagtcttgactatttatttccttcactatttcaaatatagttattttaataactgcatctgataactctatttgctagagcccctgtggttctttcatattgtctatggtttcttttgcatttctttcatatagttttggtcctcacgtttctggttatttttgattgagtacagggcaggtatataaaaattcatagacaaattggaggtctagaatgtagttatcttgtttcagagaggatatacttttacttctatgagatggatagacagtagcatcaagaattaccttaatccaactcaagaaactgaaatgatttcaagctgtattgtaattcccgagggagccagtctacttctgatttacccactcccaggctgtggccttttatggtctcaactcaaattatgagagctttatataaaaaaaaaatccaccttggtaaaacttaaattccaattttccctcttccccataagatatcgatagtactgatcagcttctcagccatttcttccaaaatcaacaagggcccttaggaaaaaatggtcccaaatgtctggctcacttcattttctcctggatcatggcttggcaattatttactggctctgatgccttcaagcagatgttatttttattttatttgtttattttgggacagggtttcactctgtcgcccaggctggagtgaagtggcatgatcttggctcactgcaacctcctcctcccgggttcaagcgattctcatgcctcagcctcctgagtagctggcactacaggcacctgccaccatgctccgctactgttttctatttttagtagagatggggtgtcagcgtgttggccaggctggtctcgaacacctgccctaaagtgatccacctgccttggcctcctaaagtgctgggattacaggcatgagccactgtgcctggtctagcggatgttctttatatttgtgtatcttttcaagttgtcattgttaagaggattattctgaattacacaggccaccattactggaagagagctttgggttttagaaatttatactttatctacagtagttttttttttttttccagtgggaatgctaattgtattgggggtaaaaatgcttctggcacctaaacatcacacaaactgcaggatgtttaatatccctggtccttgacgctaaatgctggttacaacctcctcctctcctcccccctcacaactcatggtaaaactaagaccacagaggtttataaggtactcattaagttcacatttggaaatgtgaaataatttcatttgtgtcatatccttctataccttttcatagtaaacctctgctctgattgaccctttagaggtatacaaccttttttaaagtaaaaaaggtcaggtgaatggttcttggctaaaatcaattaagtcaatggttagtagggaccacagacaagctgcaggtagtccatgaatctactaaatttacttccaggctgcatgcagtggctcatgcctataatcccagctctttgggaggccaaagcaggaggactgcttgagcccaggagtctgagaacagcctgggcaacatggcgagaccctgtctctataaaacaaaaaaattaaaaaaattaactgggtatgattgcatgtgcctatcatcccagctactcaagaggctaaggagggaagactgcttgagcccagggtgttgggggctgtagtaagctgtgttcatgccactgcattccagccttggtgatgactaagatcctgtctccaaaaaaattttttttgttaatttccaaaagtttatggagggagaatgtaatcaacaagatgttctttggagacatgccaccaggaagggattatgtacgtcatattagatagatatgcattaaatatctatttaatatgaaattaaagaaaatagctttaaatattttaaggcttaactatgctcagtgagtaaaaacttgcactagaagagaagggagatgtaattttttaattgacaaaaactatatatttacagtgtacaacacgatgttttgaaatatgtacacattgcagataggctaaattgaactaattaatacatgcattacttcacatactttttttttgtggtaagaacacttaaaatccattctcttaatgatgttcaagtatacaatacattgttattaactgtagtcaccatgttgcatagtagatatcttgaacttatttctcctaattgaaattttgtatcttttgaccaaagggagatattattttagagttggcatgagaagaggcaaatgtagctggaaagaattactttgaaattgatatcaccactcattttaattcagatattagaagactctatttatatttatactaatctcctctaaggctttctaactttcactgattgaagttaaagcagaagtatatggatagggacactgatgaaaagggtggtaagatacagagcaaaactacaagcaaaattcaacaagagacaggagggaagcaagagggtagaatttctgtgcaagaaattaagaattccatgaagaggcagggtatggaccttagggaagggaagatttcagcataactaggaaaagacaaacacagatggagagcaatgagagtgggacactcataggcaggatatataaaggacaagtcagaggtaacgtaaatgggaatctttgggcagccctggtttgaaatatcctcatttttaagttatatatttcttaaataatgtaaaagctgtccaaggtacagtggacactttctagaatcctcccaatctttcatcctaaccattgccgaaaaattggagataaagtcctcagatagatggtgggatgagaagaatgagactcagagtcccatctgacaaggcttccacaaaagcagttcatctatggaaatgcaaaatatatcatctattcatcttttagcataaagaaaatatgtccactttccttctatgttagagtacagtggcaccatcatagctcattgcagtcttgaatttttgggctcaagtgatacatctacctcagcctccctagtagctgagatttcaggtgtgcaccaacatgcccagctaatgttttaaaattttttctgtagatatggggtctcactatgttgtccaggttgatctcaaattcctgggctcaaacaatcctcctgcctcggcctcccaaagtactgtgattacaggcatgagctaccacacccgtcccatccactttctaaaagtctaactgacctaaggaaaaaaggggcctgagttaaaatttttaaaaagaatgaacagtaggtaagatcaggacccacaaaattatatatctcctatatataaaatatttaatggtttaaaaaacattttcttgattcatgtgaggtgatgtcgacttaaaataaatcctttaatcataggcttctacaagatgacattgaaaatgggagaaaagacatacccaattgctggaacaggagagccacactagtgcccgtgataggaagactatcatgtaaaggagtctggatcaactgtctatctcctgcacccaaagaaaacagcttctgcagaatgggagaaacacaaacacacacacacacgatttcagccattttttaaaaaataaaaataccttcgatgttcatttttagagcaaacgaccatgtaagatccaattaacagatacaaaaggcaacaatgtatatcccaaaacatttaagttctttgtatacttaagtggcataagaaaattcagtggctgaaagttgaaaatctagtagagataagacacaaaaatcattgataatcataactggctaaaaaataatgaaatgttaaagtcaacaactttaataaaggctcataaagcaattcaagtttagacccatctgtgaccaaactcacatttaatattctgccctttgagcagaggtagaagaatgaaggaggagagagcaagagagacagagaaaaaaggaggataaaaatttaagacaaaagacaatgagaaagatagaagagaagtaaaaaggcgaagggcaagaaaaagaaatgccaatcccactataagcaggatctttgtcagactgaagacaatgtgatttttagaaggctgtcctctttcccaatattatataagaataagcaaaataaattatcacctattcatttttaaggtttaaggaaaaaatctatccttttaaaagtatggttgaccaagaaacaataaataaatcatagcagcagagattcttatttttctactttagagacaaatatgaaaatctcaagacatacagaataaatgaatctattaataagtagttacaatgtaacaaagaactgtgttgagagttttcttaatgtcatcttctaatttttatcactccaacatgtttcaatttaggttaataaaaatgagatgtaactatatacaggagtgagaaaggtaaaagagaacatttaaaagttcaacttaatatatttccaagaaaatacaaactgcagttcaagttacacaaaatatgacttctaattatgctatgtgaaagatgaaccctgtgttaaaattaacctcatgacctaagaaaagaatggaatcttgagtgtctagaaagcagaccatggggacaatgcttaactaaagtaggatcttccttaaaacaaaaatatttaaagaattatttctttccctttctccataaattaaattaactggaggagaggggaagaggaacaatccttctccacctctctttctattctatttacctgagaccctccagccgctgggacaaggcaggcacaaaggtttgcaattagactttccaaggagacattcaggctgtccacatacacggtatagatcaaacccaggcaagcctgcaaaaagataaatacatgtaattatttcatggaaaaagcattaaaaataaattgttatgacatctgctctaggacgatttctctttgaacccagtaaagtatattatacagtgaacatggaatacattttaaacagcaaaaattaagtttattaaattttccttagaaccagaacccccaaatgagcttctgagatgagtttatagaaagcagaaatccataatttgtaaaacagatgtttgtgctctgataactactctagcaaatctgtagggctaatactgtttttgcctcaacttaagtctgttaaactctaaatctcaagacaaaaacttagaaattttatcttgtttggtggttcttataaatccggaatgcttattctacagaaaaatttaacatgtgaattgtaagaaaggattgcaaaacagagacaagattgtaagattaacactgagttcagaaggaggtaggtggtaaaacagacataatgcaatctttatgaatctttcagtatagcaaaatttgtgactctgaaaacttagtatttgcttggagttacgcattgtcattgaaatcttgacactaatttaattcttttataacacaaataatctcaatttctagaaaagttttacagaaattgtatcttagcacaaatatttacaaatgaataaaaatttcctcttatgtttgaaaattctgtgtttctaaaacaagaaaatacctggaagcaatattttaagactattttgacagaagtatgatcagaattgtttgaaatctcaaacacccaccctatttacttgaacctgattcctcacaaggtgaatatacatacacgaatttgttaaatcactcatgcatttacatttactacaggtaatcaaattatttctttaggatgtatacattctggattcaataaatgtgggacctattttaaaacaaacactacatccttagaagttttagtagtcacattaacttattcaggtatttatttcacccaacatgaaaatatttcttctgttcatgctaactgtatttcatagatgaattcctaaatcaatctaacaatattttcaatccaaagaacttgtaccatggttcattcaagagactcacacaataatacaaattaataatgataactatgtgttctttaccctaaaaatttctggataatataatctggataccaacaccaggcttttgggagcaaacacttctgcaggctgaattaaaccagacacttttgcttcaccttcaatctcttccttctttgttccctagaaaaagagacactgaaatcaacaaacagaagggatttcctaggttcataattcacaaaagatgaatatcaccttaaatataacttatgcaaattcaaaattaattataatataattttaaaaatcaaactacaaataaagaatagactttaagagcattctaaaagtaaagtagacaaattatgaagccgggaatacttatttcatttttgaaaagctccttaagctccagacatataacacaactttatttgagcatttcctttctgagtgaatcaagggcaaataagacatgctcaaattattttaaatagtgacccaattaaaaattatactcacttagatgaaaagttaaaaaatgatatttaaatgaagtcagttttcaaaagaagatgttttgcaaatatgacactaattttcatgttggtttttctacttgtctcaatgtctcaaacaaggattctaaggcttgcagaatgcttggtgctcaatgctcttggcagtaaagcacaatcggctctaaattgcttttgttcataagcaacaatgctgatattttgagaaaagagaactctgtttccgtttttgaaacaaggtcttgctctgttgcccaggctggagggcagtggcacaatcacagtgcactgcagcctcaactttctgggcgttagggatcctcccacctcagcctcccaagtggttggaatcataggcacactccaccacgccaggttaattttttgttttttgtagaggcagggtctccctatgttgcccagctggtttcaaactactgagctcaagtgatgctcctgccttatgcttccaaagtgctggattataggtgtgagccatcatgcttggctgagagaacatttttacatacaaaactgaatttcagaaagtacttaatgccactgaactgaatacttaaaaatggctaaatggcaaatcttatacatatatattttaccacaataaaaaacgcttaaaacaatacataagtttcaataactaaacactggttaataaacttgacaaaatatgattctcccgcttaacaaacccaaaatcgtgattcccctctttttaataacctatatcccactgtcaacaaaccctgatttcttacctcctctattgctaccataacgctgtgagctactataatctcttgtgtggattactctaacagcctcccttcatctcctttattcttctttagccccactttgcttccttgctgctctttaaacacactgggcatgctcccatccactgctctatgcgcttctgtgttattcctttgcctaaatactctttccacagatattctaatgacttagttcctcatcacttttaagttttcattcaagcatcttctgctctaataagcttttgctgacaatgttatttaaaactgcaatgccctaacactctctacccactttctctgctttatttttctccatggcatttgttactatccaacatatttatctatttcacttatcttgttttttagtttgtctgtcaactgcactagcacatgctcccataaaggccaggatttctgttttgttcaacggtgatttcccagttcctaaaataagggctaggcccatagctgatacttaatatttattcattgcatacatgcatgaatacattttcttggcatagttttttgagcattttatcaagggaagtcttttcccccctattcatagaggccaataattatattttctacttcctttagagctcatttagtttctagtacaatgcaatataaccaagtattagatgtctgtggaatgtgcacatccaaagggaactatctgtttagtttttgtatgtatgatagagtccatatgctcttgaaagattttcatttattacaaagcaaaaacaaaaattaggttggttggtttctggaatccttagaaataataaaaatgtgatgaatatgaattcaccaaagatttccacacttaatgaatcatattcttcatggattactaactaattcaaaatgacaaaagaatgactaaaattcttggaagagataaagctatccacattttatgagattgtgataaatgccctagagtaccattagaagccagctagagtaagtagataaccatttcaaatatatgaccatttactaactttgaccaaaacacaaaatagaatgcattggtcatttcttaaagctgctcttcaattaaacactcaccaaaaggaatagttattaacgagaaagaaaaaggtccaatagagtgaaaatcagtattaagtaaaaaataattttaatttatatcactttttattacgatgttgacttttcctttgtaaatgtgctacaaatcctaaaatattcttagttcttaatttcaatatctctcctataagaatgcaatgtcctaagtttagagaaaaaattcttatttctgcttttaaagcaaaatgtactgctgtgattaaacacacacacacacacacacacacacaacaaataaaccccaaatttattaggtaaaataaagtttgttctagaatggtaatgtgacatttttgataaaatttttctagaaataatttatcatgtcagaggaatactccctcttctatatagctgctagatgtattctatgtaataattataaaatgacactagttttatttggtgtgtgttttacaatgacagattttcacccattggaaagatgtgaaaaacttaaaaataagcaggaaattcaaaacatagtctatgaatatgagatattctaataatgctaaatttaatattttatactacaaaagtttcacatattttatccagctgaacaatattttaaaggctttgccaacttaagattatttcttctcattaaattggccacttaaagattattccttgcttttagtaggtctcattaaagatacaaatttatcttaaacactgtttactaaatatctcacattgacttacaaggtcaatacatataataatcacatgccacaacttgcccatttgtagatatctttgcctaccaattactactatggattacatctgctagtgattcccagcttctgtgtaacttatgtgtagttcatcatctctgtgcttcaataatatgggataaattagtactcaccatatcaatctggcctaaaagtgctactgctcttaaaacatatcctgagacaaaaagtactagattgctgattgcacgcaataacttgatgtagcagatcagcacaagctttaaggaagtttatcctaccattcaggttgaacacttcagcctcatctttgttgtatcttgatgcttaattttaatatcaaaataactgtcaagtcctgacccttttatccttaaagaactgttgcatccaacatcttctctgtgctatgttcatttttaacaatactgtatcacactaaaaatcttcccgcagcatttcttaaataatcagttataaaaggaggataaaattaattccacaagtaaaaaattttcagtcctaaatttcctttctgaaatgtaatatatagcaagtataccattatatagaattgtctcagtaaagcaatttaagaacttaaaaattttccagaattggaaataatggagcctaagtagttgcaaaattctgtaagttctaaaattcctcctgaacccttcatttcttgccaaataatcttttaatcaagttgacatgtctacatgatcaaaccaggtttgccctttcattggtctgggaaataatgaatgcataagaaatacacattttaggataacaagccttcaaacaaactaggcctctagtcttcagttcagaatctccgctcgctgcaagctccacctcctgggttcatgccattctcctgcctcagcctcctgagaggctgggactagaggcacccgccaccacgcctggctaattttttctttttttttgtatttttagtagagatggggtttcaccgtgttagccaggatagtctcgatctcctgacctcgtgatctgcccacctcggcctcccaaagtgctgggattacaggtatgagccaccacgcccagcctaaagtcttaaacgtaagacctaaaaccataaaaaccctagaagaaaacctagccaataccattcaagacataagcatgggcaaagacttcacgtctaaaacaccaaaagcaatggcaacaaaagccaaaattgacaaatgggatctaattaaactaaagagcttctgcacagcaaaagaaactatcagcagagtgaacaggcaacctacagaatgggagaaaaattttgcaatctacccatctgacaaagggctaatatccagaatctacaaaggacttaaacaaatttaaaagaaaaaaacaaacaaccccatcaacaagtgggcacaggatatgaacagacacttctcaaaagaagacatttatgcagccaaaagacatgaaaaaaatgctcatcatcactggtcatcagagaaatgcaaatcaaaatcacaatgagataccatctcacaccagttagaatggtgatcattaaaaagtcaggaaacaacagatgctggagaggatgtggagaaacaggaatgcttttacactgttgggagtgaaaactagttcaaccattgtggtagacagtgtggcgattccttgaggatctagaactagaaatgccatttcacccagccaccacattactgggtgtatacccaaaggattataaatcattctactataaagacacatgcacacgtatgcttattgtgacactattcacaataggaaagacttagaatgaacccatatgtccaccaataatagatcggattaagcaaatgtggcacatatacaccatggaatactatgcagccataaaaaaggatgagttcatgtcctttgtagggacatggatgaagctggaaaccataattctcggcaaactaacacaagaacagaaaaccaaacaccgcatgttctcactcataagtgggagttgaacaatgagaacacatggacacagggcggggaacatcacacactggggcctgtcagtgggtagtggggttaggggagcgatagcattaggagaaatatttaatgtagatgacaggttgatgggtgcagcaaaccaccatggcacatgtatacctatgtaacaaaactgcatgttctgcacatgtaccccagaacttaaagtatacttaaaaaaaataaaagtatactttattcagaagatgacttgcaatagtattctgcgggacataatttaaagtatatctgctatgaacaatattaaaatatatctttaaaatcagatatagttaacatgacagaataagaaaaataatacagtagtggaagatatttaaaatctatgctacctacttcattttataaatcagtaatcacatgcccagagggatgaaatgacttgccaaggtcatacagatcattaaaggcataagtgggattaacaagccaagtcttctcttaagctacttctctttccagtatcctatactcttatatgtaacctttataagaaataacatattagttaaaataagctgtttaggaaagataacatctgagacgccaaactgtcaatttgaaaagatgttcaggtttgttttcctttaattatatttgaatgtagtaatttttgttttaaaatgaaatagtaacaatacacagttctcactgcagcccttcctagcctgaaatagttgtcaaaatttaagaaaaggtatttgatgttgaaggattctggaaacttaatcccaaaagtttctcctgttgttttaaagtcttatatcattttaagcatgttgcaccaattaatcatagttaatccagtgacagtttttccctacaaaatacatctgtgagggacatcaaggggactgttaagattcagcattctgtccatttgccaattctcattttcaaaaggggaggagaagacagattctttggtaaaagacataatcttcagcatcgatactctaaggagaatcccatgtggatacttgcaaagttgtaaattatcaaactatagaataaactcagaatacacaagtctcccaattttttctctgtgtgaattatgttacgcatgctagttttcaccagactctaacaaagtctagtcttgttgaataagacctaagaattagtctctagaatgctaccaagtgtaaagttgattacaatatcagcaagcccaattcccaaatactgctatttcgaatttttagttcaaagagttggattacctgggactaaacccttcttgaaggaactaaggtttttccaatgagatattcatcacagttattcataatattgacaaaacaggaaatacatgtccatcaggggattaattaaacctacctatatggtcaactagtgtacagcaacttttgttaaaaaaaaaaaatccttattattggaagaaaatatgtcaaaccatctttttctgttctctcaaattttttcctgcatgttctctctatgtcttctacaatgagcatagtttactatgataaagagcgggatggtgggggtgggggagtaccaaaaatgattgggttgtagtacttcagctaaatctatacactgttttgtgtgtggttttctccactgttttataccatctagagacgaatttataaattcctttttattactccattttccaggtaattacttaactgcttggaattaattatatgatactatgtttaaatttttttcttttctcaaatagctcatcaactgtttaaataatatttgttgaaatacacacattccattgatttataaagcttctattgttggacactgatctcctatacacaatagggtctgcttctggagtattggttttgttcccataattgtttttacccttgacacttaattcttgaacctatagcacactgatacaatttttgcagctttgtagtatatgtggttattatttggtccttggagacagaatcaatcaagcactttaacttggtactgaatgtccctaagtaagcctcatctgtaaaatggaaatgttaaaacctatcaaatggtgttttgtgagaataaactatatgtgagttaaataaaatagaatgaaataaagtgttgtaaaacttttagcacagtacccagaacataagactttaatttatcataagcactacaatcttttttcctttgcacaagctttttgtttgaattgtcctttttctttcccttactctaggtgttagctcttattaaaatgtccactgagtcttttaaactctgtatgatttattccagttgcctagtctgcaattattatctgtttcactgaatgatacttagcatatgatactttggaatggttttgtacttaagttttggttctgcttcccaagctagatttgaagcccactgtgatggagaaacgtatcttatgtcttctatgtctctccctcttttttcctcctcttatctctcgaaattacaaaattcattccctctctctttctttgatgacaatttgatgacacaccaaatgttctcactgagaactgcataattaccactgattcagagacaagtatataaacatatgaaataactttaaaaagatatagaactaaatttaaattttagatatttaaaattttatacttttaacatattttaagataatcaaatgattatttagataagtaataaaagtcaatgtaaatctatcatattttgctgattacttaaaaaaatttaggatcacattacctagttgagtaattttgggaacatattatcaaaagtttaatgccaagttttgcttatgattactgacagtgttactgtatcttggaaagataacagagctaacatttttaaagttgcacaatcacattctggatggtgtatgtccctaagttccccctctttaggcttccaaataatgtgtcatagtatatttggtatgaagtaattcacaccaaaaaagaattaaaagatctattttgaactgatgatatgatccaaaaagaaaagaaaaacacatttttaaagggacataaacagttcatgccaaaaatgaaaacaactttactgatgacaagaaagaaacatcttctgggttctatttttttttcaaattctgcttcattgtttatccctcttttccaccaagcccaaaagacattaacttatgtttccagaaaagtggtcttacaattctggctagtacctaagtacaattatatagaatccggaattctcacaacctatccgcattttcaaaatcttggaaaaactgatatgaagcagactgtaaccttttgtaaggtgatcgtaacaaataaattatgatttctgggcccacttaaaatggcaagtaggaaaatatctaagctaaaaagagaaataacttcttgacatatggattcaaactatacaagaacccagatcttagcttctaatattattccctattcaaaggagtcagactccttgaagaaatggctgatttcaaggcagaggcagggaaggaataaaatgatcctagatcaacttgttatgatgaaaagttaaaaagtactttttctaaaaggagatctgtgaaaagaacacaggaatctgtctgagtggtgcacgctggtcaaatatgggataatttgtgcattaaaataataaaaaccattaatgatttacatattattgacaaaaaaaaaacctgaatccatgtatctgtagctcaaacagacaggaagagagagttcctgcttatagtaaaaggtcgactgctgactgctaaaaatagagggagtatggagttagaaaataatcattttttgttatcagaatcaaaattgctataggcaagaatcattagtaaatgctgaaatctaggggaacatgattgatgaacagtaggatatttgcatagtgttagagtgtcttctagtagactgattattaattgcaaacataaaaatcgccactatgaagtggagaaatctgacaatcatctgaccaagttaccaaaattaacatcatcagtgagggacagacaggcattgtggacttccggatgtgtactcttagaaggatgcccttagaaggaacacaggtaatattccaactgttgacacagcctgaaactaacaatgagagatactggaaaacagaaaataagaaacattgtattaaaaatggggggtgagaagttacattatttaaaaatgtcaacattatagacaaaggcagcacaagtattccagatgaaaagagacgaaagagaaataaaaactaaatgcaatatatgtagtatgtactagatcctgtactggaagaaaaaagggatgggggggtgctataaaggacactattagatcaaatgacaaaactggaatatggatagtaggttttattatattgatgttaaatttcctgaggttgataactgtactgtttacgtactgttcatgtacctctgaagcatatactaaagaatttaggtgtgtgtgtgtatgggggagatggggagaggagagaggggaagagggaagaagggataaagagaggaaagaagggtagggaagaaagacctcaaataaaacgatggggcaaaatattaacaacaggtgaatatgggtaaaggctatatacatgtttgcattattcttgcaacttttctgtaagtttaaaattatttccaaattaaaagtttgaaaaatacccaagaattcctagaacctatttataaacatctgccattaatataatgtcaatatattgcctttctgtcagtttgtctagaagaagaggggtgaatagtgaagagggagaatctaaataattatagttagtttcattagataattccaaagagttgtgaagcgataccctcaagaatatggaaataacagaatatactgaattctcagcattaacttaaatgctaaagatcaacagagaaacgaaaggccaataaaagagacagagtggttcttgggctagagaacactctctaacttattcagattgaactgataaaaatgagaatttgattagctatttgttggcaacatatatccaaacattatccaggggagaggagacttaaagtcacagactgaaagttttctgtccccattgataacatacagtaatctctaacttcaaatagaagcaacaggctatgttagtctgatagtctttaagtatttaacatcaaatatcggtttgattccataatcaaaactccggactttgatatggctttctactaagatctggtgacaggaagacaatgtgctgataatgcatgttttgttctatatgcattttcagcacttttcacatttcctataaattagtagtctagcatgttagttttaacacatcagtctaatgaacttgaataatgagtctgcatcatgaaaggtaatttgtctcttcttgtactcaaaaatcagatttctgcatccagaaaattcagatcttagagtttaataaacataatcaaaactaccaaatactcctttgttaagccatttcagaaagcaggccaatcttttcccccaagtgatgatactctatacgtagcagaaactacagtagattatgcaaactggcttactcaatatcttcgaagtcccctttatggtttccttcttgtattatagagcctggaaagaaaaaccaccaccaccagcaccaacaaaaaaaaccctacactttttggggcaaaatgggctctgtatacaatcttaacttccaccaaagaaacaactcatgtaaaacttaaaagcagaagtcagcagtatgagactaaagcagaagtcagcagtgtgaatatctgcaggagaatggatattctagcacaactatggtgaaggttataatgtctgatatatacccagcattgtaagtgccaagtggtaaaaggtggaaggaatatggtttctatgagaatagcaccaagctgggctgttcctagtacccagaattggttccctgcttgtccctcacccctaaaatttcacaagttgccaaatactttgttatgactcctttctgcttagagaaagtagagccagtaatgtgaaactaagaacctcaaccaatagtctgaaagagcaattattttatatgtcttcatagttctagcttatgaatttctgcctgatcatgttgataataccacccctaagaagaatgagttaacatttgggtgcttaaacaataatgtcaagcattgtaataatgatttgcaaacattgtgagtaaatgttccacattctatgaaagacctcccaggagaagggctggcagggaaaatcacaggttcaccaagagaagaaattaatattcttaataaaccaattcaaggatgcactatttttagaaatattcagattatgatcaatgttttgaaaaaggacaattaaatctggaaagtaattttaacatgttgctctcctctccaaccttaaacataaaaatttcttcatgcttcttatgctagcccataaaactcaaacttgcagttgtaacaaaaatatggcatataaaaaacattcctaaatgttgtaccttcgactgtactttagctagtaaaggtttttgtacctgaagattgatctctgcctcatagaaggttaggcatgagcagtaatgtcgatctgagtcaatgtctgtcaggacaaccacaaagaacgttggctgcttcctctctctggacagctgccacccgccaggctgacaaaactaaatgaaatagaaaaaaaaatgtaacatttaaaaacaataaaagttaattattaatctctgagaaattttaaatgtttgcccattttaacaaattcctacctgatgtggtatgagtctaaagccaacatttaaaaaaaagttaatgtacagattcataatggtgaaaactttcaccaatgtgcatatatatttcatgaagatagcctcgatttcccacagttgccactctgggtgccatttctgagacccaggtaggcctatgtaggaataccgcatcaaaattaaagacatcccccaactatgagaacaaatcatggaatacattagaaatcaagggcaaaatatgtatcattgagggaaaatagaattatttttaaatttccatatgaatctgagagtcttcaattcattacaaaaaaagagatatcttgttcagcaagacagaccacattcttgtccataaaacatacttcaacaaatttaaaaaagaggaatcatagaatgtctgctgttagaccatgacagaattaaactagaaatcaataacaggcagatagctggaaaatccagaaatacttgcaggttaaacaacactttcttttttttttgagatagggtcttgtttcatcacccaggctgcagtgcagtggcatgatcacagctcactttaaccccaaccccctgggctcaggcgattctcccatctcagcctcctgagtagctgggactacaggtgcctaccagtatatctggctaatattttttattttgtagagaaagggtctttccatgttgtccaggctggtctcgaactcctgggctcaagcaattctcctgtgtcagtctcccaaagtgccaggattataggcataagctactgcacccagccaaacaatactttttaaataacatgagtcaaagatgaaatctcaagagaaatttaaaaaatattttgagctaactgaaaatgaaaataaaacatcaaaatttgtgtgatgtgatgaaagcagtgcttatagaaaaatttctatcattgaatgcacatattagaaaagaagaaagatctaaagtcagtaaactaagctttgacctttggaaactagaaaagaagagcaaattacatccagagtaagcaaataaagaaaataaaagttagaattgaaatcaatgatactgaaaacagaaaatcagtagagaaaaatcaataaaataaaaggctgcttctttgaaaagctcaataagcctctagccaggctaattaagaaaaaaaaaaaaaggcacaaattactaacaaatgaaatgaaagacgggatatcagtacagattgttctgggcgggagacccgcaagaggagaagaaaaggcacacacacaatacctttaaaggtaaacaagctttatcccatgtaaatggcaatgtagatataataagcaaattatataataagcaaagtaataaaataagcaaatgatataataagcaaattgcaacgcaaaggggagaagggaaaagagataaatgtctctacactcaccagactatggaggattcaccaccagactgggaagcaacagtctgggctccagagttggacactgcactcaccagactatggaggattcaccatgccagaggtggtgaattcctcttcaaagggtttaattgtgtaatgtccttggttcaaaggccccaccttcttgtactttctcatttttagcctgcaagcagccctcctgctcttgctgtgccctaacttgcccagacatgtccagacacgtcttgtgccatagcagaagaaccacttctacccgctcccttgcgaattgtgcatctaccctatttgttcagtgtgctcttgtgatcgtggctgatgcagggagcacccttctgcagaagtaaattgccttgctgagaacgctttttgcctgagtgctggtttcactttgcagcaccaagcacttgtttctaacaaccactagactgggaagcaacagcctgggctctatagtcagccacttgtctgtgcacagacaaagagaggtctcatgaagcttcagcacagtgtgggaccctagctgtttttgtaacgagttgtttggcaggaggtccagtcatgaaggcccttcgtgactggactcaaggaacacaaaaaggtcaacttgtttttgtgactatctattgcttttctttttttttttttttgagatgagtcctgctctgtcgcccaggctggagtgcagtggcacgatcttggctcactgcaacctccgcctcctgggttcaagtgattctcctgcttcagcctcctgagtagctgggattacaggtgcccgccatcatgcccaggtaattcatgtattttagtagcgatggggttttgcaatgttggccaggctggtcttgaactcctgacttcaagtgatccacccgccttggcctcccaaagtggtgggattacaggcatgagccactgcacccggcctattgcttttcaaaaaccaaggtataggaatagattgaaatagagatttctctgaaacagtgctggacgaacgcctgaaggggctcacacaacctgtgccaggacttggtgaccattgtttgtgtccacgttcaattgagttcaaatttaatatttaacttttcctccacacaaaagttcccatgaacttttaaaggataatcaatgaatattatgcacaagtctatgcccacagctttgacaatgtagagaaatgtaccaatttcttgaaagacacaatctaccaaaactcacacaagaaatggacaatcagcatagtcctatattgttaaagaaactgaatcaataattaataactttccaaaacagaaagcaccaggcccagatggattgactggtggattcttttaaacatttaaggaagaagttacagtcagccctctgtatctgtgggttctacatctgtggattcaaccaaccacggatcaaaaatatttgaaaaaaaaagaaaaataacaatacaactataaaaatagcatatataaaaatccaggatagtagctatttacataacatttacattgtcttaggtataagtaatctagagatgatttacaatatacaggaggatatgcatgggttatatgcacataccacaccatttaacataaaacatttgaacatcctcggattttggtatgtgtgggggattcttggaaccaatcccctgcagattccaaaggacaactgtataccaattatctgcaacctctttcagaaaacagaagcaaagggaataccttcttcattctatgaggccagcactatactaataccaaaaccagataaagacatttacagaaataaaaattattgaccaatattgctcataaacataaaagcaaaaatattagcaagttgaattcaacaatgaataaaaataatatcatgaccaagtggaattcatcccaggcatgcaaggctggttaaccattcaaaaatcaattaaagcattatatcgtatcaacaggctaaagaataataatcatgtgatcataccaatagatgcagaaaatgcatttgacaaaatccaatacctattgatgataaacagcctcagtacactagaagtagagggaaacttcctcaacttgataaagaatatcttttaaaaaaaaaaaactcctatggctagtaccatacttaatgctgaaaaactcaaagctttccaagaatgatcaggggaataaagtaaggatgcccctttcaccactgcttctcaatattatcctacaagtcctagttaacgcaataaaatgaaaaaaataaaaagtatatatattgggaggaaagaaacaaaactgcttttgttcacagatgacatgattgtgtaaacagataatctgaaaggacaaaaaaaaaaaaaaaacccatccctggaactaataagcaattaaaaacaagttctaagatacaaagttaatatacaaaaatcaaccacttttcctttatgtcagaagtaagtggaatttgaggcaaaaatataataccatttacattagcactccactaaaccaaataattaggtataaatctaacaagatacgcaaaagatctatataaggaaaactataacactctgatgaaagaaatcaaagaactaaataaatgaagagagattctatgttcatggataggaagactcaatactgacaaaatgtcagtttgtcccactttgacccaaggattcaacataattccaacaaaaatcccagcaagttattttatggatattaacaaaatgatcctaaagtttataaagagaggcaaaagatccaggatagccaatacaatattggagaaaaacagctggaggactgacactaccaaactttgagacctaccaggaagctatagtagacaagacagtgtgatactggcaaaagaataggcaaagagatcaacaaaacagaatagagagcccgaagtagactacacaaataccttcaactgatcttatatacacatgcaaagtgctcagagaagcccctggcatataatccagtggacgtaaatgttaggtattatgaccattaccccctttgatccaacccatgtttctatccccatctctttgacattttcctcttttgtacagacgttttccaaaactagctcctcctttcactgtctcattgcctaccttgtatgagtctagagatatcagaaaagtaagatcgacatgatttcctacatttggagagggatgttaatcatgttcacagtttctctagagaaaggcttaactgtaccttaattagcaaatcagtaaaaacatttctattacatatttagtttaaaatagcaatttattcaaaatattattgataacttaagaatcatttattctatgaagtcttctttgaaacttcctagcttctctcgccctctccaaaccaaagaatcaggccacgctgttcctctactatactccaaaaccatctttattatgaataacaacaacaataataacctatcctcctctatatttccctagaactttttatctattaatactaatctggtaaagaaaagccgacatcattatctttatgtgtcccttggtatctgtggaggattggttccaggtcccctcactaatatcaaaatctgcagataatcaagtcccacagtcagccctcaggaagctgcagatatgaaaaactggcccttgatatccacatatttttctctcaacaacccatctatactaaattccataaccctatatctcaggcttatttgtgactgcaataagcctttttattctagaatagcagctatcaaaagagtccccaatgtcaaaattattttcataataaacctaagatattggttgtttctttactgtgagtaaaactgcttgtgtcttaataggaatcaaagcagtggcaccaaactatactagtaattgctgtattctttatagctgcacatttgcaataaaaaagtcagttttaattgaaaaggcccttgatgaggcaataaacattttaatttcattataactggcattatatatgccaaacatattttggcagacatgtatttggcagacattttctcaacataaatcaactgggcctgtcacttcaagataaagatctaagacaatttgttatcaatgataaaatatgagctttcaagcacctgagagttttgtaatattttaagacttctatgacaaatattatcatactattagttaatttatattttaagtattatatagtgacatgtgtcaatatttggaagctgtatataactcactaaacccatatttgtcaaatgaccagtgcatgatattataaaatcatgcatgtgaaagatccattcaaagtgcccagtagaccaacagattttaatgtaaccataagaaaagttcacagatgtggttacaaattccacactgtaactaacctttaagaaactactattcattggatattggagcagtatataaagaaaagtatccgtaattatctgaaaaagctactaaatactccttcctcttccaatgacatatttttgagatttgattttcttcatatacttcaaccaaaaaaatcaaatcacaagagcttgaatgcaaaagcaggtatgagaatccagctgcttctatgaagccaaatatcaaagacatttacaaaaatgtaacacagtatcactcttttctgtatttttttgttttggaaaagatggttatttttcataaaaacatggtatttttgttaacatggaatgggattttgttatttaaaagtgggtaaatttaaaaaaaaattttattttagttgtggctgggtgcgatggctcacgcctgtaaccccagcactttgggaggctgaagtgagtggatcacttgaggtcagaagtttgagaccagcctggccaacatggtgaaaccccacttctactgaaaatataaaaattagctgggtgtggtggcacatatctgcaatgtcagctacttgggaggctgagacagaagaatcgcttgaacctgggaggcggatgttgcagtgagcaaagatcgcgctattgcactccagcctgggcaacaagagagagactccatcttaaaaaaaaaaattagttgtaatttctaatatataaatgaattgataaaaccacataaaactcttttagaattctcaataatttgtgacagtataaagggtactgagactaaaagtatgggaactgctattttaatgagaatgggtgttaacatgtaactatccttggcttaaactacttgggtagcagaacggtataatccttggtagaactggaaagttttatcaggctacaataaaagccaaaaatatctttcaaaatccttttactttctctcaacaaacttctttcgtgaataaggtacatcattttctaaaatgagcctcagaatcaggaaggaagtatgtgagcttaggttataacataatgtaacgatacagcctgcatcatcagttctaccaccaccacaaactgcccctctgataaaaagtgaatcagttctgtgaattaacagcaaataatcccattctcatagaagtctgtcattcatatcattagctaatcactaggcttggtaaatggtactaaaaaacatacactagagaatgatgactgcatattttcacatctttaaagaaactacaggttttcaataaggacaaacaaaatcccttcattttagttctaattctaccaaatatatttgacttctcaaattgaagttacctaacagaaataacaatgcaactttttataaccatatacatataggcatataagtcccctcttatccatggaggatatgttcaagatcccacagtggttacctaaaactgtggataataccgaaccctgtatgtactatgtatgtatgtatatggaaccctatatgtactatgttttttcctatacatacataacaatgatgtttagtttataagttatacatagtaagagatgaacaataactaataataaaatataacaattatgatattagactataataaaagttatatgaatggggtctctctcaaaatgtattattgtattatacttgcccttcttatgataatgtgagatgatttaatgcctctgtgatgagatgaaaggtgaatgacataaacattgtgacatagctataggctactattgaccttctgatggtaaatcagataagatggctactaagtgactaatgggtgcatagtgtatacagtgtggataagctggacaaagggatgatgcatatcccaggtgggatggtgtgagatttcatcatactactcagatggtgcataatttaaaaccaatgaattgtttctggaattttccatttaatatttttggacctcagttgaccatgggtaaataaaaccacagaaagcaaaaccatgggtaagggggaaactacagcagatctattaaatgagcagtcagatattttgctgcctgaaactagaaaaaataactattaatgtgcccatttttctcaaatgctttgcacatatagacaatataagagaaatataccagaataacaaaaatgtccatagcactgtgattaaattgaatgatctcttgaaggtgaaatattataggtttcaatatttcccaagaccttcatctgcatccataaatgtttagctattgagccatgttttaatgtataacatttaaattaaatgtgtctctttttaaaaagcctgtaagaaaattccttctcctaatagaaaataataaacatataacatcgagaaaaagaatgtgagagtttagatagtaagaccaccttagttacttaaatagcctcataaatatgttagtttacactataagaataattctgtgattaaaaaagtattacccttaaaacttttgggaaattccaaggatcaattttcaaatccaatagacttcttcaaaactcagcttaatgtgaccacagctcaaatagtatagtaattaatggttggcctggtcagattttttttactaaatttttcacaaagaggttgttaagatagttaactagacactggttacgtatgagatcctctatttcacacgtaaatgacattaaatatattgtgcatttaaaaataccattagaatcatagtttataggaaattttgaattctatattctcaaataaaatacagtaacatagacatagtctatgttacacagtttacaaaaattctttctcaaaggatgaaaagaaatgaccctaacctgcagttaaatgagtctttttcaaattcactgtatcataagattaagcaataatagatttgggagtatcagaatacaaactcacaatttaatgagaagtactcctcatagaatttggatttcaaatataacaatgctagctggtttagtcttttccattcttaactaaaaatgtgttagagaaataaacaatgaggatgtggacattacaattcttgaacctgggtttaagtcacacttctgacaggaatgtgaggaaaatgtttagacagctggagagtagtcactaaaagatagtaagcaggatgataagcattatacaaacaggataaaaatcaggatttttctctccccagtgtctttataggcaaacaggaaaaaaaaaaagctatcacaggtgcaaaacccaaaatgtttagaatcgactgtcataacagactgacctaacactgtgccctccttttttcaagtcactgagaaaacacatatatttgtaatggcaaaacataccacataatctcacaataccgttttgatacctgcatgagtgtatgagcaacgacttgtttttgacaactcccttctaccttgacttcaccatttcacacataccatgcccataaaaatgttaacaacgtatctgggaacaggcaatgtgggaatccttttcaggatgttcttctgtctttgtttatctctagttttctttaagaacttagtataacctataagcaaattatacttcaagtttgcaaggctggaattgttagacattgctaaactctatatgttaatgcattacaaacacccgctttgtttacttgcttgtttgtttaattgcccaaatgtatgaagtagataacttgcaaataggccatccatctgcaaataaaaggtacgtgctaatataataatctctcaggtttgtaagatattttatatataaccatatctcacaagactcattctacaaacaatgaaaccaagactgttagacattaaggtcataaagagtttgtggcactggcaggactagaatccaagtctctgcatttctataaaccgtgttctttcacttctaaattaccttcataaatcaccttatgcatattgttttatgctaatataaatacatggcagaaaaacttaagaaataaaatgaaagtgaaataaattttgtaacatgtaacatttcctagcaaccatttatctctgaaggtatgcatgtatgtatgtatgtgtgtgtgtgtatttatccaaaggagggcatattgtatatatagttatgaatcctgtttttctccccttcctataacatgtattttcccatgtatttatatatttttaacataattatttttaataactgaatattataccatcatgtagatatagataaaatatcataaccaattccctattgttggttaagatgtttataattttttataattaatgctgaaataagcatagtactatataaatatttccagatatgtctttttattttctcagggaaatagaactggttttctagagcatgcacaagttgagcacaaaaatgtttaattatccttgaattcctttttaaaggttaagcaaccccaaaattgttttgtttttcctgatacatttctaaagaggacagaaaagaagtgataacaaagaactgttattataaactatattctgaccaaagaagaactgatttgtgaataaagtaacagaagctttaggagactgaagtctgtgccaagccaggccagggcagtgtcagatgtgtgctctgaacattatatagatattcttcaaaagtttgaaaaaagacccagcctggtggctcatgcctgtaatcccagcaatttgggaggctgaggccagaggaccacttgagcctaggcataagaggctgcaatgagctgagatcgcaccaccacacttcagccttggtgaagagtgagaccttgtctcggaaaaaaaaaaaaaaattaaccaagagtagtggcatgcacctgtagtaccaactactcagaaggctggggtaggaggattgcttgagcctgggaggttgagggtgcagagagctgtgatcatgacactgcacttgagcctgggtgacagagtgagattctgttcttccaccaaaaaaaaaaaaagttcagagaaaatatagtgggcagaagactttggaagagaagtcaatttaagagtttgtgacatctcaaacattttgtttttacagaataatgcatgtcacatataggcccaattttaataagcagcttttgataaagtatatacttaaaagggactatccaaaattatttgcttaaaatggaaacttaactgaaatgggtcacctatattgcttttggtaaaaatttacatccagatattttattactactatacaacatttgcattgtcctcaccacaataaaactttcattacgtgtaagataatatgattgtctgcctagagaatacatacaaactgactaaacactgtttcaactagtaagagtttacttaggtaggcagatatacaaacatacacaaatcaaaagttttctttgacatcagcaataagcaattagaaaaaagatcctatttgtaatcttaatatgttctcaaagacaaaggataagctaacctaacttctaagttttgaatattttggtatatcagtctcatgaacagattaaggctttacatttaaaaatttcatgactaaggccccgaaagtaaatgcaacaaaaacaaaaataaatgaagcagacctaattgaactaaaaaagcttctgcaaaacaaaagaaataatcaacggagtgaacagacaacttatagaatgggaggaaaatattgttaaactatggatctgacaaggactaatatccaaaatctataagaaacttaaatcagcaagaagaaaacaaataatcgtattaaaaagtggacaaatgacatgaacagatatttcttaaaagaagatatacaaacggccaggaaacatgaaaaaatgctcaacatcactaatcattaggaaaatgcaaactaaaaccacaacgagataccaccatgagaatgcccattatttttatttgtttgcatgttttttttttgtttttttgtttgttgtttgttttgagacagtcttgccctgtcacccaagctggagtgcggtggcaagatctcggctcactgcaacctccacctcccaggttcaagcaattatcttgcctcagtctcctggaactataggcgtgcaccaccatgcctggttaattttcgtatttttagtaaagacggggttttaccatgctggccaggctggtctggaactcctgacctcaggtgatccacccacctcagcctccccaagtgctgagattacaggtgtgagccaccaagcccggtcagaatggctattattaaaaagtcaaaaaaacaaaagatgttggcatggatgtggtaaaaagggaacacttatatgctgctgctgggaatgtaaattagaattgcctctagagtaaacagtaaagaaatttctctaagaactaaaagtagatctaccatttgatccagcaatcccactactgggtgtcttaccaaaaggaaaagaattcagtatatgaaaaagacacctgcatgaattatgtttatcacagcacaattcacaattgcaaagataaagaatcaacttaagtgcccaccaacagatgagtaaataaagaaaatgatacacacacacacacacacacacacacacacacacacacacacacacaccatggaatactactaactcataaaaaagaacaaaataatgttttttgcagcaacttggattaaactggagggttattacctaagaaaaacaactcaggaatggaaaaccaaataccacattttttacttttaagtaagagctaagctatgattatgcaagggcatacagtggtataacggacaatagagtcccagaagtggggaaatggggaaggtagatggggtaagaaatgaaaaactacctattgggtacatagtacactatcttggtaatgggtatactaaaatcccagactttaccatgatataatctttccatgtaaccaaaaaccacttataccccactaaagttattgaaataaaaaaatttaaaatgaagtaaatataaaaatttcaagaagaaaattaaagagaaaaataaacacttggaatagttttgaacattcaagttttgaaaaaacaaaacagaaaaaataccctgcaaactaattataagtttaaaataattccaagatgaagaccacagaagaaaagtttttgtaccaatgccatgctgttttggtcactgtagccttgcactatagtttgaagtcaggtaacatgatttttccagctttgctctttttgctgaggtttgccttggctattcaagttcctttttggttccatataaattttaaaataattttttctagtcctgtgaagaatgtcgttggtagtttgttaggaatagcattgaatctgtacattgctttgggcagtgtagccattttaatgatactgattcttcctatatatgagcatgggatgtctttccattcatttgtgtcttctctgatttctttgagcagtgatttgtaattctcattgtagagatctttcaccttcctggttagctgtattcctaggtaattatttttgtgtgtcacagttgtgaatggggttgcctttctgatttggctctcagtttggttgttgttggtgtataggaatcctagtgattttcgtatattgattttgtatcctgcaactttgctgaagatgtttattagctgaagaagcagttctaacaaaaagtggccacactgctgctttacatgagtgggtaatcctgttcctcatcactgagcaggacctcccaaccagggcctccagccaccctcgcctgaggtttccagccaacagagaactgaatttcccctgggatggtgctccagagggaggggctggccaccatctttgctgtttgggtgacttaaccgttctagtctttgggctttggagtgtctgaggcaactgggggctgaaatggaccccagcacagcacaactgctctattaaaatgtggccagactgtttttttaagcagttccaatcccgttcctcctcactgggtgggacctcccaaaaagggtctccagcaacttcctacaggtgcctttgggccagcaacaggtctgtacctccctgggacaaagctcccagagggagaaacacgctcccatctttgctgtttcacagccttcactggtgacacttctaggttctggaaaatctgaggtgactagagactgcagcgggccccaagcatactgtagcagccctatggaaaagtggccagactgttacatgggtgcctgttcccatatctcctcactgtgcaggtcctccaggcctgagcctccagccaccccctgccagaactatcaagccagtaccaactcagcaacaccctggacacagcctctctgccactacctctgcaatgtaactgcccttgtcacccttggactaacaaaggagcaaagaccctaagtaccttatccacacctccaacaagtggcagctgacccaaggagaggaggccagtctttctcccatgggtcccacaaaccccccatatcttgtcatcagacagggaacccctggcttgggcccacagcgcaaactctctatcctgggatgattgcactgagtgattgctgacctgcatctctctggggtggagcctccaggagtcaagcaaatgacccttggccacaaccactactaagatttcttcctctgctgcctctaagctgaggaaggaacataaacacagagattgccccaaagttgcagtgggcagcccaggagtaccaagtcatgaactacagccagtactcaagtgggagaggagcccatactttcaaagcactgagagggaacatggctacaactgtgaggaaacatagggaagccacacaaccaagcaagaatcaaccaactgaccaataagcctaagtgtcacctgctggatcacaccccaaagccttaacaccaaaaatacctcactaacatatccccctctaaaaccagagacaagaagtcagcttcaaataaagaccctacacaaagtcctggcctgatgaaaacatccagaaaagaagtctattgagtgtactcaatctacactgcaattaaagaaacacccacacacagagatgagaaagaacagtgcgagaactctgttaactccaatggtccagagagtctgtcatatgtcctccaaatgactgcaccagttctccaacaagagttcttaactaggccaaactggatggattgacgaatagaattcagaatatggataggaacaaagatcagtaagattcaggaggatggcaaaacccaatccaaggaaaataagaatcacaataaagtgatatgggagccaaaggacaaaatagctagtatgaaaaagaacctaacaggtctgatagagctgaaaaacacaatataagaatttgacaatgcaatcacaagtattaagagtagaataaatcaaactgaggaaagaatctcagaacttgaagactggttctctcaaaaaagatggtcagacaaaaataaggaaaaaagaataaaaaggaatgaacaaaactttcaagaagtatgagattatgtaaacagaaatctatgaatcactggcatctctgaaatggagggggagaaagcaaacaacgtggaacatatatttcaggatgttgtccatgaaaacttccccaaccttgttagagaggccaatcagtcaaattaaggaaatacagagaactcctgcaacattctacacaagaagatcatccccaagacacataatcatcagattttcaaaatgaaagaaagaatgtgaaaggcaactagagagaaagggcaggtcacctacaaagggaactccatcaggctgacagtagaccattcagttgaaatcctacaagccagaagagattgggggcctatattcaacattaataaagaaaaaaaccttcaaccaagaatttcatatccagccaaactaagcttcctatatgatggagaaatacgatccttttcagataagcaaatactgagggacttcattaccatcagacctgccttacaagagatcttgaaaggaacattaaatatagaaaggaaagacttctaccagctaatacaaaaacacacttaaacacacagaccagtgtcactgtaaagcaaccacacaaacatgacaacataataaccagctaacagtacaatgacaggatcaaatccacacataacaatattaacctcaaatataaacaggctaaatgacccacttaaaaggcacaaagtagcaagctggataaagctggataaaaacaagactcaatgatatgttgtcttcaagagacccatctcatgtgtaatgacattcataggctcaaaataaaagcatagagaaagatctaccaagccaataaaaaagcaggggttgcaatactaatttgagatagaaaaagtttcaaaccaacaaagataaaaaaaagacaagaaatagcaatacataatgataaagggttcaattcaacaagaagacctaactatcctaaattaaacaagaaaattaaccaaaatattcaggacctaaactcagcattggaccaaatggatctcatagacctttacagaagtttccacccaaaaacaacagaatatacattcttctcatcaccatatggcacatactctaaaattgaccacataattggacataaaacaatcctcaacaaatgtaaaagaaccgacatcataccaaacacactcttggaccacagtgcaataaaaatagaagtcaacacaatgaaaattgctcaaaaccatacaattatttggaaaataaacaacatgctcctgagtgattttggggtaaataatgaaattgaggcagaaataaagaagttctttaaaattaatgacaacaataatacaacataccagaatctctgggacacagctaaagcagtgttaagagaagaatacatagcactaaatgtccacatcaaaaagttaggaatatctcaaattaacaacctaacttcacaaagcaaaagaattagagaagcaagaacaaatcaaccccaaagctagcagaagacgagaaataacaaaaatcagagctaaactgaaggacactgagacacaaaaagtcattcagaggatcaataatccaggaattggctttttgaaaacaattaataaaacaggccaatagctagactaattacgaagaaaagagagaaaacccaaataaacagaattagaaatggcaaaggggatgttactactgaacccacagaaacaaaaataaccatcagaaactactatgaacacccctccgcacacaaaaactagaaaaccttgaagagattaataaattcctggacacatataccctcccaagactaagccaggaagaaactgaatctctgaacagactactaacaagctccgaaactgaatcagtaataaatagcctaccaaccaaagaaaagcccaggaactgacggattcacagctgaattctaccaggtgtacaaagaagagctagtaatattcctatagaaactattcccaaaaattgaggaggaaggacttcttcttaactcattctaggaggccagcatcatcctgatacctaaacttggcagagacacaacagagaaagaaaacctcaggccaatacccttgatgaacatcaatgcaaaaatcctcaacaaaatacttgcaaactgagtccagcagcacatcaaaaagctaacccaccatgaccaagtaggcttcatccctgggatgcaaagttggttcaacatataaaaatctgtaaacgtggccaggtgcggtggctcatgcctgtaatcccagcactttgggaggccgaggcaggaggatcacgaggttaggcgatcgagaccatcctggctaacacggttaaaccctgtctctactaaaaatacaaaaaattagccaggcgtggtagtgggcacctgtagtcccagctactccggaggctgaggcaggagaatagtgtgaacctggaaggtggagcttgcagtaggctgagatcgtgccactacattccagcctgagcaacagagcgagactccatctcaaaaaaaaataaataaataaacaaataaatctgtaaatgtgattcataatataaacagaactaaagacaaaaaccacataattatatcactagatgcagaaagggcctttgataaaattaaatatcccttcacgttaagaactcttaacaaactacatattgaaggaacatacctcaaaataataagagccatctatgacaaactcacagcccacattatacagaatggtcaaaatctggaagcactccccttgaaaactggcacaagacaaggatgccctctctcaccacttaatattggaattcccagccagagcaatcaggcaagagaaagaaataaaggacatccaaataggaagagaggaagtcaaactatatctgtttgcagatgacatgattctatatctagaaaaccccaggctcagcccaaaagctccttcagctgataaacaacttcagcaaagttgcaggatacaaaatcaatatacgaaaatcactagcattcctatacaccaacaacaacgaaaccgagagccaaatcagaaaggcaacccattcacaattcccacacataaaataataaaatacacaggaatacagttaaccaggaaggtgaaagatctctacaatgagaattacaaaacactgctcgaagaaatcagagtagacacaaacaaatggaaaaacatcccatgctcatgtataggaagaatcaatatcattaaaatggctaccttgcccaaagccatttacagactcaatgctattcctatcaaactaccaatgacattcttcacaggactagaaaaaactattttaaaatttatatggaaccaaaaaagagtctgtatagccaaggcaaatctcagcaaaaagagcaaagctggaggaatcatgttacctgacttcaaactatagtgcaaggctacagtaaccaaaaatagcatggtactggtacaagcacagacacacagaccaatggaagagaccaatagagagcccagaaataaggccacacatctatggccatctgatctttgacaacgctgacaaaaactagcaatggagaaaagactccctaaatggtactgggataactggctagccatatgcagaatactgaagctggaccccttcctcacaccatatacaaaaatcaactcatgatgaattaaagacttaaatgtaaaacccaaaactataaataccctggaagacaacctaggtaataccctcatggatctaggaataggcaaagatttcatgacgaagtcaccaaaaccaattgtaacagaaccaaaaattgacaaatggggtctaatttaacttaggaacttccgcacagcaaaagaaactatcaacagagtaaagagaagcctacagactgggagaaaatttatgcaaactatgcatctgacaaaggtccaatatccagaatctataaggaacttaaacaaatttataagagaagaacaaacaacctcattaaaaagtgggcaaaggacatgaacagaccattttaaaaaaagacatacatgtggccaataagcatatggaaacaagctcaatatcactgatcattagagaaatgcaaatcaaaaccacaatgagataccatttcacaccagtcagaacggctatattaaaaattcaaaaaataacagatgctggcaaggttgtggagaaaagagaacccttatacactgttggtgggagtgtaaattagttcaaccattttggaaagcagtacggtgattcctcaaagagctaaaagcagaactaccatttgactcagcaatctcgttactgagtatatacccaaaggaatataaagcattctaccataaagacccagacacgtgaatgttcactgcagcactgttcacaacagcaaagacatggaatcaacctaaatgctcatcaatgacagacaggataaagaaaatgtggtacatatacacatggaatatcatgcagccataaaaaagaaagagatcatgtcttttgccggaccatggatggagctacaggctatcatccttagcaaactaatgcaggaacagaaaggcaaataccgcatgttctcacttataagaacatatgaacacaaagaaggaaataacagacactggggtctacttgacaggggagggtggaagaagggagaagaacagaaaagataactattgggtacttggcttaataacttggtaatgtaataatatgtacaacaaacccccgacacatgtttatctatgtaacaaaccttcacatgtaccctctaacctaaagtaaaaaaaatatatatatatatatatttttttaatttttttattttatttttttttgagacagagtcttgctctgtcgcccaggctggagtgcagtggcgtgatctcggctcactgcaagccctgcctcctaggttcacgccattctcctgcctcagcctcccgagtagctgggactacagatgccctgcaccacgcccagctatttctttgtattttttagtagagacgggtttcatcatgttagccaggatggtctcgatctcctgacctcatgatctgcctgagtcggcctcccaaagtgctgggattacagacgtgagccaccgcgcctggccaaaaattttttaaaagttagaaattataatataaaaaaactcaaactactgaagacaaaaaccataatgtctgagataaaagacaaatcaaatgatattcacaacagattagatgctatggaagaaaagactagtaaacttaagtttacaccaataaaaattatctaaaataaaacacacacacacacacacacacacacacagagagagagagagagagagagaaaacgaaaagagaatcagtgagctgtaagagaacttcaagtggcctaaaatataagtaacaggaattaaggcgtcggggggagcaaaaatattttaagaaataatggcaaaactaataccagatgcaaatatgactgcataaaacaatgaagaataccagatggagtaactacatgggtaaatgcataagattttttttattatttaaatatcttttaaagatgattgactatataaataaaaataacactgcagcatggggtttatagcatatataaaactacaatatatgtcaacaatagcacaaaatttgggaagggagaaatgaaagagtactcttgctgtatagttcttatactataggaaaagtgatacagtatcacttgaaagtagaatatacaaattaaagattgcataagttaaacaaggattgtttaagcccaaaagtaaccactaaaatgaaaatacagtgagttgtaactaataagccaacaaaggacttaacctaaaagaaggctgaaaaataaagggtaaaaaggaccaatggaatgaacagaaaacagtaaaataatagattccagcctaaccatattagtcatcacattaaatagattttaagaccacgtaaaaaagcaagacccaactacatactgtgtacaagaaacattttaaatacaaagactcgaaaaggttaaaagaaaaaggaggggaaacagatatattatgctaccattaaataaataaagctaaagtggctacattaatatcaacgtagatttcagaaattttttttaaacaggaagaagacattttataatgatatatgggccaattaatcaagagaacataaaatcctaaacatttttgtacataataaagatctttgaactatgtgaaacaaatctgatagaacagcaagagggaagaggcaaatatcctctatttcagtcaaagatttcaaaaccccctctcaataacagatagaacgaatagaaaaatagtgaggatatagacgatctgaacaatctgtcaatcaacttgacctatttgatgtttatagaacactccacacagcagcagcagaatatgcattcttctcaagtacatctgaattagttgccaaaccagaccatatactgggccactaagtaagccacaataaaattaaaatgatttaaacaatataaaatatgttctcatgtcaaagggaattaaattagaaatgaaaaacagaaatatctcttgaaaaatcataaatttaaaaactaaatgcatacctaaataactcataaaccaaagaagaagtcaaaagaaaaaatggaaattattcagaactaaatgaaaatgaaaacaacctataaaaatttgtaggatgctactaaagtagtatgtaaggggaaatttatagcactaaacacttaaaatgttatagaaagcttcaatcgatgaactcagtttccaccttaagaaatcagatgaagagaaagttaaatcaaagtaaataaacaagaaaagataatagggataaaaacagaaatcaataaaataaaaagtagacacagtaataaaaaatcaactaaagcaaaagtttgttctttgagataaaaaaaactttagccacactgatcacacacagagaaaaaaatgttaatatttggaataagatgatatcactagaatttctatagctattaaaaggatcataagggaatattatgaaaaacatcctataaataaacttgacaacttagacgaaataaagaaattctctaaaagacacaaactactggccaggcacagtgacgcacgcctgtaatcccagcactttgggaggccaaggcaggtggatcacttgaggtcaggagttcgagaccagcttaacatggtgaaaccccgtctctactaaaaatacaaaaactagccaggtgtgacggtgcatgtctgtaatcccagctactcaggaggctgaggcaggagaatccttgaacccagggggtggaagttgcagtgagccaagatcgcgccattgcactccagcctgggcaagaagaacaaaactccttctcaaacaacaaacaaacaaacaaacaaaaaaccagacaaactaccaaacctcactcatgaagacataacctgaataaccctatatccattgaagaaaataaaactatagttaaaaaactttccacaaaaacaaaaacaaaaaaccctacagttccagatggcttcactggtaaattctactaaacattaaaggttttttccttaaaaaaataacagcaattctacccaaactcttctaaaaaaacggaaaaatatagaatactttccaacccattttataaggccgacattaccaataccaaaacttgataaagacattacaagaaaactacagttcaatatccctcatgaacacagttgtaaaaatactaaatatctatatatctatatatctatatctatatatatatatcttttattttagcaaattgaatccaaccatgtaataaaaggctaacatatcatgaccaagcggggtttaacacaggaatacagggttgatttacatttgaaaagcaatcaacagaattcattttaacatgtttacataaaaaagaaacaaactaagaaaaatgatatgatcatttcaatacaaacagaaaacgcatttgacaaaagtgagcaaacacttctgttaaaaactctgagtacactaggagaaaaaccagatttccttaacctaataaagagcattgatgtgaaatccacagctaacatcatacttaatgttgaaaaaccgaatgcttttccactaagatcagaaacaagataggcacgtcttctatcaccacttgtattcaactttgtgctccaggttctagcctgggcaatcaagcaaaaaaaaggaaggaacccgattgctgaaaatctacagagaaaaatctacaaagagtggactctacaaagagtgtctagaacaaataagtttagcaaggtagtagaacacatgatcaatatataaaaatcaattacatttcttcctattagcaatgagcaaaccagaaatttaaattaaaatgtcatttataaaagcatcaagaatatgaactaggctaggtatggtggctcacacctgtaatcccagcattttgggagtgtgaaatgggaagactgcttgaggccaggagattgagaccagcctgggcaacacagtgggaccctgactctgttttttttaaaatgaattacttagggatacatatgtcaaaagatgtgaaagagctggacaatgaaaattacaaaacactgctgaggaaaactaaataagacccaaacaaataggaagatgtatattgttgaagggctggccaacttgatattgtcaagatgtcaattcttctacaagtcaatctatgtttgaataaatctacagatttgatgcaatcccagtccaagtgtcaccaggttttttggttgtgtgtttgtttttttgagggggagggggaaagtgaggacagtagaagttgtaaaactgagtttgaaattccagtgaaaatgtaaaggacctagaatgccaaaacaactctgaaacagactaaattggagaagtaacactacctgattccaagaattgtggtaaagcaacattaaccaaaaaaacaaaaacaaaaacaaaaacaaaacaaaaaaatgcccagcatagtactagagtaaagaaatggaaataaggtctggtgtggtgactcacacctataatctcagcaccatgggaggccaaggcagaaggattgcttgagtccagtagtttgagaccaacctgggcaacatagggagaccctgtctctataaaaaataacgacaaccaaaaaacaaaaacttagctgtctgtgcatccagctcgagaggctgaggtgggaggatcaattgagcccaaaaggttgaagctgcagtaagctattatcatgccactgaactccagcctggcaacaaaatgatacccctcccccgaataaaaaaaagaaatgcaaacagacaaataaaacaaaacacagaaacccacacatagaaggacaactgatccctttccattaataagaaactttaacacttgctcaagaaaagtgtaactattgttaggtgttcttaaagcaggggataatgaaatcatgaaatgaagcaatgtgttaatggagaaggtccctctgctgcaggcagcagaaattctccctgcaaattggattacctgatctattgctgcttgcaaactgccagctgcaaacctagcatagcacccacatggttaaattttactttacatgtatttatacagtattaagtgcttccttaagtgattttttaaaataaatcataggcaattgagttctgattacaactcaccctttcctgaatcctcattttggtcagtttgagaaacaaggtgcttttctgtttgaatccaaggtctagccctctggctaagggtcctacataccactgacctgaccattttaaccactttcagagctgtgactttagaaatactgttttcctatttcttacccattctcattattcagactctagcactgtgtttaagacttgggattctagaataaaagacatattcaaatttcagacttgctatttacttagctgtgtgggctctccacaatcctttaattaataaaatcttaatgaaaatactgtgatataccttacgtagcttttataaaaaactattttatgcacctaaaatgtttaacatagtacctagcaaagagtaaatatttaataaatagtagctattgtattatcattattactaatattattaccgactcagcccccgtcacccctttcaaaataatgtcaacttgattcttctctacctcaaaacttgaatcaattcacagcattgttgccctcaaggagctgatgaatgaaaatacatactgattattttgaattctttaaacaattaaaatatgaatatatttttattgccgaaagcccaaacaatacagaaatttgtagagaaatcattcaaattcttgctgcccaaccaaatgatgtggggcactctacccctcacttccagccatattaatcattattaattgctttatgtgtttccttccaaatatttttgtatgcatttacctacatatgtatgtgtgcatataaatattcaggcataatttgaatagtacaatgaaacccatttacccttatttagatacactaattgtcaataattcaccacataaaaataactaattttgatttttttatattctactttaagttctagggtacatgtgcacaacgtgcaggtttgttacataggtatacatgtgccatgttggtttgctgcacccatcaactcatcatttatattaggtatttctcctaatgctatcctcccctccccccaccccccaacaggccccagggtgtgatgttccccaccctattccaagtgttctcattgttcaattcccacctatgagtgagaacatgtggtgtttggttttctgtctttgttacagtttgctaagaacgatggtttctaacttcatccatgtacctgcaaaggacatgaactcatccttttttatggctgcatagtattctatggtgtatatgtgccacattttctttatccagtctatcattgatgggcatttgggttggctccaagactttgctgctgtgaacagtgctgcaataaacatacatgtgcatgtgtctttatattagaatgattgataatcctttgggtatatacccagtaatgggattgctgggtcaaatggtatttctagttctagatccttgaggaatcaccaaactgtcttccacaatggctgaactaatttatactcccaccaacagtgtaaaagcattcctatttctccacatcctctccagcatctgttgtttcctgactttttaatgatcgccattctaactggtgtgagatggtatctcattgtggttttgatttgcatttctctgatgaccaatgatgatgagcattttttcatgtgtctgttggctgcataaatgtcttcttttgagaagtgtctgttcatatcctttgcccacttgttgatggggttgtttttttcttgtaaatttgtttaagttctttgtagattctggatattagccctttgtcagatgggtagactgcaaaatttttctcccattctgtaggttgcctgttcactctgatggtagtttcttttgctgggcagaagctctttagtttaattagatcccatttgtcaattttggcttttgttgccattgcttttggtgttttagccatgaagtcctcgcccatgcctatgtcgtaaatggtactgcctaggtttttcttctagggtttttatggttttatgtctaacatttaagtctttaatccatcttgaattaatttttgttataagatgtaaggaagggatccagtttcagttttctacatatggctagccagttttcccaacaccatttattaaatagggaatcctttccccacttcttgtttttgccaggtttgtcacagatcagatggttgtaggtgtgtggtgttatttctgaaggctttgttctgttccattggtgtatatatgtggtttggtaccagcaccatgctgttttggttactatagccttgtagtatagtttgaagtcaggtagcatgatgcctccagctttgttcattttgcttagaattgtcttggcaatgtgggctcttttttggttccatatgaactttaaaatagtttttttccaattctgtgaagaaagtcattggtagcttgatggggatggaattgaatctatagattactttgggccatatggccattttcacggtattgattcttcctatccatgagcatggaatgtttttccatttgtttgtgtcctcttttatttcgttgagcagtggtttgtagttctccctgaagaagtccttcacatcccttgtaaactggattcccaggtattttattctctttgtagcaattgtgaatgggggttcactcatggtttggctctctgtttgtctgttattggtgtataggaatgcttgtgatttttgcacactgattttgtttcctgagacactgctgaagctgcctatcagcttaaggaggttttgggctgagacgatggtgttttctaaatatacaatattgtaatccacaaacagagacaatttgacttcctctcttccaaattgaataccctttatttctttctcttgcctgattgccctggctggaacctccaacactaagttgaatagaagtggtgagagagggcatccttgtcttgtgccggttttctctttttttctctctctctctttttttttttttttttttgagagggagtctcactctgtcacccaggctggagtgtggtggcgtgatctgagctcacggcaagctctgcctcccaggttcacaccattctcctgcttcagcctccagagtacctgggactacaagcgcccgcaaccacgcctggctaattttttgtatttttcatagagatggggtttcaccatgttagccaggatggtcttgatttcccaacctcgtgatccacctgcctcggcctcccaaagtgctgggattacaggtgtgagccgccgtgcccggccattgtgccagttttcaaagggaatgcttccagtttttgcccattcagtatgatattggctgtgggtttgtcataaacagctcttattattttgagatacattccatcaatatctagtttattgagagtttttagcatgaagggctgttgaattttgctgaaggccttttttgcatctattgagataatcatgtggtttttctcactgggtctgtttatgttatggattacgtttattgatttgcatatgttgaaccagccttgcatctcagggatgaagctgacttgatcatggtggataagctttttgatgtgctgctggatttggtttgccagtattttattgaggattttcgcatcaatacagaaatttgtagggaaatcattcaagtttttgccgcccaacccaatgatgtggggcactccacccttcacctccagccatattaatcattattaattgctttatgtgtttccttccaaatattttttgtatgcatttacatacacatgtatgtgtgcatataaatattcaggcataatttgaatagtacaatgaaacccatttacccttacctagattcactaattgccaaataagtcaccacataaaaatacctaattttgacttttaaccaaaatatcttttatatcttatatagcctttaaggtagatattaagactatagttcctaaagccaaaacttcacaaacggtttctaagaaaacatgactcatatcaaggatttgtatattttaagggaaatttaagattctagtcagcacaaagtgttgacatttcaaaatctctcaggcccaacaacctactcacttcttgaagctcactaccttttaagagtcagaaatcttatgtataatgactcaggaaacagttgaagatatacttctattttttttttcaattaaaattgacaaatagtaataattctttgatttttaagaataaatgtaaaagtacttaaatagaggaaataaggtgagttccatttcaattccttttcctttcttgtaaattataaacgttggaattttactaatttcctggacaacaaatagaaggaatgctatcatttggggcttttccactaatggctgcattactatgttctcaaaaaacaaaaaaatccagtggaatcttttttttttttcttttttttttttttggagacagggtctcattctgttgcccaggctggagtgcagtggcaccatctcagatcactgctgcctcgccctcccagggtcaagcaatcatgatcctgtcaagtagctaggactacagatgcatgacaccacatatggctaattattattattattattattatcatcatcatcatcatcattatttttggtaaagacaggtttcacttttttgcccagtctggttttgaacccccgggctcaagcaatccgcctgccttggcatcccaaagtgctgggattccaggtgtgagtcatcgcacccagtggttatcttgctttcaattgactccttcaaaaggccaatatataatgtgatctgagtaatgggatgtattgcaatatgggatctacagggttgctgtgaatatgaagtgcttagaattctgcctagcaggtaagtaatcaataaaggcttatctgaagagaaataaagtaagcttttacttacaatgagttatagttatgtgtttcctatatcccttgtaaagttgaagtaaaaattattaaaattattttcattttaaaattattaaaattttcaaattccttattaaattgaaattaaggaagagcaatttccttaacaaattatatggaagaaaatcaaagaagaaactatagattaagaaagatttaagtggcccagcacagtggcttgcacctgtaatctcagcactttggaagggccaggcgggcagatcacttgaggtcaggagtttgagaccagcctggcctacatggcgaaacactgtctgtctctactaataatacaaaaactagctgggtgtggtggcatgcacctgtagtcccagctactcaggaggctgaggcatgagaattgcctgaaactgggaggcagaggttgcagtgagccaagattgtgagatcgcactactgcactctagcctgggagacagagtgcggctccaactcaaaaaaacaaaaaaaaagatttaggagacctatcaaccaaatgcatatgtagaccttgtttggatgtgaattcaaacaaaccaactgtgaaaagatagtaaatgagcaatatacacacttacatactacaagtggggaaatataaagactgcagatggttggtgatattattacttatgttttaggtatgataaatgacactgtggttgtgttaagaaaaaagaggtcttttagaagtactctaatatttatgaacaaagtgatatgaagttgaatcaaatgtaattatcattttataggtgaaaataaatggatgtagacaatttcgtatgattcaattaatacaatatttgtagtttgcttcacaataatccaattagaagggtttgaggccagtaggtagacaggtataatagagcgggaaagaaagagtgacccagagttaacgattgctgtagttgtatgatgagtacatgggagttcattgttctctatttttatcttttaatttttctatgtttttaacaagaaaaccaagagaaccctaccttatacaactgtgccttgcctaatgcttattagcactatatttgataaataataaataccaaaaacatagatgttgaacatgtttgaatcaatattctcagaaaggtccatttataagaaatgatgaattcacaaaaactcagccagcaaaggaagatcaaatggaaagacaaaaattagaaacaaaatgttcttcgaattttataaaactctcacatgtgactgactgacttttcattctgcagattttattatctctcaaagttatctctcaaagtctgtgatagctatatattcatcttttgcttattttaagtgttttatattattttacttaggctgattaaaaaatatttgcactgaactccattacctatctctgtttattaagtttagatgtagttatagactagggagaacagagaaaattgaaaatgtgtacattagattccccagagtaattttgtttttggtttttacatcagacacacacaattttaaatacaagtttatccatctgaaaagagatttcttgcttatagccaggtcaattttgtttacacatatattaaatacaatttgctaaatatagccaatgttaataagaatagattcattttaccctctgtatgtctggaatggttaagatataatagtttaaaagttacagaaaaatatattaatgtttccttaatattagggagaacgtgttaacatttaaagctgtcaaacaatggaataaactatgtcctagagaatgagaaccccttacttcacaaattaaaccagaagttggatggcaatttatcagatatactgaaaaagagattcacagagaaggctaaaacttgataatctcatggcctgtgccaccagacagacaagaatcttgatctgactcttaacttaggttataattttggtaaattacctaatttctctaaacctcagttttccttgaacacaaaatacatcattactgtcaagattaagtgatatcatgcatgtaaactggttagcattctgcctcagacattgtaagtgattaataaacactgttatagaattatgaccagtcacacaatcagtactcaagtaatgagtaacatcttcactactactgctattgctatgtaagagaataataggtagttgatatggtttggttctgtgtccccacccaaatcttatgttgaatcgtgatcccaagtgttgaaggtggggcctggtgaaaggtgattggatcatcggggcagatttcccccttgctgttcttatgatagtgaatgagttctcatgaaatctggtagtttaaaagtgtatagcactttccccttcatttgctgtctctcctgccaccatgtgaaaacatgcttgcttcctctttgcccttctgccatgattgtaagtttcctgaggcctctctgccatgcctcctgtacagccagactgtggaactgtgagtcaattaaacctcttttctttataaattaccggtcttgggtagttctttatagcagtgtgagaacagactaacacagtaattgatgaatgcaacagaggacacctctagcctgagacataaaggatgggatcgtagaggaaacagaaaaccatttctggtagtttttttttttttctgcgagttggcaaattagaggctttgttaccatagctcacccactcagaaatagcaaaatagcatgtacagattcacatggtgaactttcatccaagaagaaacatgagagctaaatataaaagcaaaagaataattgaatactttgaaaaatacagtgggcattaggctacgctgtggatctgtggtggaaaactgtgagtgaatcaccagtgtatgacgggggagagagtatcttacaatacatatttctactaaggaacgaggcaatccaggccactggggagctccgtgaccctactgagagctagatcttaagttggagaacagggagactgtaagaaggaatggcagtagaaagtgctccatatgcactcccgtctccaactactgacagaaggccattcttgatccaactaagggggctgcacgaaaaccagccagccagcacaggtggcagacactggtttggagaatcttcagatcaggacttgcaatccagtctctagtgggacaggagcccctatggccagaactgagaggtgagaatatgtgggctccagctttgggtacaggagttgggcactacccgtttgcagcatgggaccaggaggggtgtggcctgggagccatgtttttgtctcagggagggagctttgagacctggggcgatgttacaatctgaagaaagactgcttataacttggctggctgtattagcataccactggcagcaggccatgggagggagccctgccaggctgaaagcatggacttcaggcaggtcccactactgcctgctaggctgtggaaccaaaactacccttctgtccctgtattggctctttgacacagcaccagttgctctgctcctccctcgagcattgccccaggggcctgagaactgctttctgatcctccttggggacagcacttgtgcttggtgttggggatgccggagcatgggactgtccagcctagccccatttggccttgcctccatcaacctgcatctgaggaagagcttgggaacagggcccctgggagttccacagcctagtccatcacctaagacatcagagtacctctggttaacaaaggtcaagcatattgccaccacctcagctggatctcgcatgctagcgccacctactggctgcaaggccaacctgcagagcttattacattatctgttgataaaattgcatggggtttgaccactgctcaaggaaataaaagaggacacaaacaaatggaagaacattccatgctcatggataggaagaaccaatatcgtgaaaatggccatacggctcaaagtaatttatagattcaatgccatccccatcaagctaccaatgactttcttcacagaattggaaaaaactactttaaagttcatatggaccccaaaaagggcccatattgccaatacaatcctaagcaaaaagaacaaagctggaggcatcatgctacctgacttcaaactatactacaaggctacagtaaccaaaataatatggtactggtaccaaaccacatctatacaccaatggaataacaaacaccacacatctacaaccatctcatctttgacaagcctgacaaaaacaagcaatggggaaaggattccctatttaataaacggtgttgggaaaactggcaagccatatgcagaaagctgaaactggatcccttccttaaaccttatacaaaaattaactcaagatggattaaagacttaaatgttagacataaaaccattaaaaatcctagaagaaaacgtaggcaataccatgtagcacataggcatgggcaaagacttcatgactaaaacaccaaaagcaatggcaacaaagccaaaatagacaaatgggatctaattaaactaaagagcttctgcacagcaaaagaaactatcagcagagtgaacaggcaacctacaggataggagaaaatttctgcaaactatccatctgacaaagggctaatatccagaatctacaaagaacttaaacaaatttacaagaaaaaaacaaacaacctcatcaacaagtgggcaaaggatatgaacagacacttctcaaaagaagacatttatgcagccaacaaacttatgaaaaaatgctcatcatcactggtcattagagaaatgcaaatcaaaaccacaatgagataccatctcatgccatttagaatggcgatcattaaaaattcaggaaacaaaagatgctggagaggatatggagaaatagaaacgcttttacactagtgtaaactagttcaaccattgtggaagacagtgtggtgactcctcaaggatctagagctagtaataccatttgatccagtgatcccattactgggtatatacccaaaggattatcaatcattctaatataaagacacatgaacacatatgtttactgtagcactgttcacaatagcaaagacttggaaccaacccaaatgcccatcaatgatagagtggataaagaaaatgtggcacatatacaccatggaatactatgcagccataaaaaaggatgagttcatgtcctttgtagggacatggatgaaactggaaaccatcattctcagcaaagtaacacaaggacagaaaaccaaacaccacatgttctcattcataagtgggagttgaacaatgagaacacatggacacagggaggggaatatcacacatcagggcctatcgggggtttgggggctgggggagggatagcattaggagaaatacctaatgtaaatgacgagttgatgggtgcagcaaaccaacatggcacacgtatacctacgtaacaaacctgcaggttgtgcacatgtaccccagaacttaaagtataataataaaaaacaaatttaaaaaaattgcatgaggtttgaagaacagacaagctctgtgtgacctctactaccaacaccacaccctggctactcaggaggacttgaacccatttgctcaaccttacattatgactgcaactagcatttaagaaatccaccaaactgaggctatttataaccaagaaaatcatacatagtctatgccaccaaatgcacccataagcaaagccagagaaccctactcaacatacaccacagatgcatcctgaagaagaaaaaaagttacctttcagtaaaagtgaattcaaaaataagaagaagcgactgttaccccatatgcaaatgtatcagtgcaataatactggaaatatttaaaaaaacacaagatgctatgacatctcaaagaaacgccgtaattctatagcgatggagcctaacaaaaaagaaatctcacaacaatgtacaagagaaaccagaaaactaatgcaaagaaattagaaaataaattcaggatataattgagaaatctgcaaagatacatacaactacatcagtatctacatttacaggatatgactgagaaattcaccaaagatatctacatccccctatttatctataaagccaaaccaaacttttggaaatgaaaaatttattgaagaaattccataatacagttgaaagttctgacaacagactagaccaaatggaagaaagaatctcagaaactgaagacaggtctttcaaattaatccagttagacaaaagttttttaaaaaaggatttaataaacaaacaaagcatttgagaagtatggaactataaaaacaagactgaacctacaaatcataggtactcctgagaaataaaaaagtttggacacctgatttgaggaaataattatggaaaactaccttattctagcagaagatccagatattcaaatacaagaggctccatgaactccggaaattacattgcaagaaagaactcaccatgacatagtcatcagaatgcctatggttaacattaagaggggaaaaaaaattctaaaatcagcaagagtaaagcatctagtgacctatcaaggaaatcccaagagactaacagtagacttctcagcagaaaccttacaagccagagagattgagattctattttcaaagtgcttaaagaaaaaaaaatgtgggacaggcacgatggctcatgcctgtaatccctgcactttaggaggctgagcagggtggatcacctgaggtcaggagtttgagaccagcctggccaacatggtgaaaccctgtctctactaaaaacacaaaaattagccaggcctggtagtgtgtgcctgtagtctcagctacttggaaggctgaggcaggagaattgcttgaacccgggaggcagaggttgcagtgagccgaggtcacaccactgcactccagcctggaaaataagagcgaaactctgtctcaaaaaaaaaaaaaaaaaaaaaagtaaaccccaaattttatatcctgctagaataagtaaaggagtaataaagtctttcctagacaaggaaatgctgatggaattcatcaccactagaccggtcctatcaaaaaaactcaaagaagtttttaacatggaaacaaaaggttgacactctccatcctaacaaaacacaaaagtataaaactcacaggtcttataaaacaattacacttatgagaaagacacataaatcatatggcaatgtgacaaaaccctactaaacctaaaaagacagagaaaaaaaaaagaatcccaaaggcaagtagatagaaacattatgatagaaacaaaaaccttacatatcaatattactctttaacataaattgattaaatgctctacttaaaagatacagattcgtggaatgaatttaaaaacagatccaactatattctgcttatgagaaatttgccttactcataaagacatgtacagactgaaggtaaaggggtaaaaaaacatattccatgcaaacaaaaatcaaacgcaagcagaaatagctatacttatatcagacaaaacagactttacatcaacagtagtaaaaaaaaggaagtctttatgtaataataaagcaatcaattcaccaagaaaatataacaatcctaaatatatatggacccaacactgcagcacccagattcataaaacaagtattactaaacctaagagaaaaatatagatagcaatacaatactagtgggggatgtcagcacaccactgacagcactacgcagagtatcatgacagaaaattaaagtggactttagaccaagtggacctatagacatttacagaacattctatacaaggaatatatcaacagatggaacattctccaagacagtaactatattaggtcacaaaaaaagtctcaataaattttaaaaaaatctcaaaatcataccaagtatcttcttggaccacagtggaataaaaccagaaatcaattccaagaggaactttcaaaaccatacaaacacatagaaattaaagaatatgctcctgaatgatctatgggtcaacaatgaaattaaggcagaaatttacaacaaaaattgaaaagaatgaaaatggagacacaacatatcaaaaacctctgggatacagcaaaagcagtgctaagagggaaatttataacattaaatacctccatttaaagaaatggctgggcacggtagctcacacctgtaatcccagcactttgggaggctgagacggatagatcgtctgaggtcaggagatcgagaccatcctggctaacatggtgaaaccccatctctactaaaattacaaaaaattagccaggcgtggtgacacgcgcctgtagtcctagctactcgggaggctgaggcaggaggatcgcttgaacctggaaggcagaggttacagtgagctgagattgcgccactgcactccagcctgacccacagagcaagactccacctcaaaaaaaaaaaaaaagaaaaagaaatattgcacattagcaacctgacattgtatctcaaggaactagaaaaccaagaacaaaccaaactcaaagctagaagaacaaaagaaataacaaagattcaagcaaatagaaagaaattgagaccaaaaaaataaaacataaaggatcaacaaaaaattaaaaagttgatacttagaaaatataaacaaaattgatagaacacttgactaaccacgaaaaggagagaagattcaaataaacacaatcagaaaagaaaaaggagacattgcaactgataccacagaaatgcaaaagagcatcagagactactatgagcagctctacattcacaaactagaaaaccaaaaggaaatggataagttcctggaaacacacaacctcccaagactgaaccagaaggaaatagaaattatgaattgactaataattagtgagattgaactagtaataaaaattcacccatcaacaaaaaagtccaggaccagagaattcacagccaaattctaccagatatacaaagaatagctggtaccagtcctactaaaactgttcaaaaaattaatgtggacggaaacttccctaactcattctatgatgccagtattaccctgatatcaaagcacagtaaatacacaacaatgacgacaaaaaagaaaactacatatcaatatccctcttgaacacagacacaaaaatccttgacggaatactagaaaactgaattcaacagcacgtcaaaaggataatgcaccatgatcaagtaggttttattcccgggatgcaaaaatggctcaatatatgcaaatcaataaatgtgattcactagataaacacaattaaaaacaaaaaccatatgatcatctcaacagatgcaaaaaatcatttgataaaattcagcatccctttataataaaaaccttcaacaaaataggtacagaaggaacatatctcaatgtaataaaagccatataaaacaaacccacagtcaacatcatactgaagggggaaaaagatgaaaatatttcccctaagagctgggacaagataaggatgctcgctatcaccactcctattcaacacagtactggaaatcccagccagagcaaccaggcaagagaaagaaataaaaggcgtccaaattggaaaagaattcaaatgatctctgccaacaatatgatcttatacctagaaaaccctaaagactcctccaaaagactcctgtatttgataaatgaattcattaaagtttcagcatacaaatcaacatacaaaaatcagtaccatttctatacaccaataactaccaaactgagaaccaaatcaagaagtcaatcctatttacaatagctaccaaaaccaaaacaacacagctctaggaatacagttaacgaaggaggtgaaagatctctacaaggacaactataagatactgatgaaaaaaactgtagatgacacaaacaaatgtaagaacatcccacaccatgaatttgaagaatcaatatcattaaaacaatgatgctgacaaaagcagtctacagattcaatgcaatccctatccaaatacgaacatcattttttcacagaattagaaaaaataatcctaaaattcacatggaatcaagggagagctgaaatagccaaagaaatcctgagcaaaaagaacaaagttggaggccccatagtacctggcttcaaattacacaaggctataataaccaaaacagcattgtactaatataaaaatagatacagatcaatggaacataccagagaactaaataaagccacatgcctacagacaattgatttctgatagagtcaacaaaaacatacaatggggaaaggacaccttattcaataaatggtgctagggaaattggagtgccatatggagaagaataaaatagaacccatatctctcaccatatgcaaaaattaattcaagatggattaaagacttaaatataagacctgaaactataaaaaaataccagaagaaaacgtaggaaaaactcttctggacattgacctaaggaaatgattcattactaaaacctcaaaagcaaatgcaacaaaagcaaaaatggatggccatggtggctgacacctggaatcccagcatctctggaagtcatgcttgaggccacgagttcaagactagcccaggcaacacagggagaccacatctctataaaacatacacaaataaacaaatgtgaattaattaaaccaaaaagcttatgcacagcaaaagaaataatcaacagagtgaacaaacagtctgcaaaatggcagaaaatgtttgcaaagtatctatccaacaagggactaatactcagaatctatgaggaattcaaactaagaacaaaacaaaacaaaaaattaaccttattaaaaagtgtagaaagatgtttgcctacataacaaacctgcacatcctgcacatgtatcctggaacttttggaaaaaaaaaagtgtgcaaaagacatgaacaggcattattcagaagaagacatacaaatgaccaaaaagcataggaaaaaatgctcaagttcagtaataatcagagaaatacaagataaaaccacaatgaggcatcatcttataccagtcagaatggctattattaaaaagtcaaaaaataacagatgttggtgaggatacaaagaaaagagaatgcttatacactgttgggtgggaatgtaaattagcacaacctctgtagaaaacagtatgaagatatctcaaagaactaaaaatggaactagcattatatccagcaatcccactactgggtatctactgaaaggaaaataagttatgacataaaaaagatgcctgcacttatgtatgtttattgtagcactattcacaatggcaaagatatgaaaccaaactaagtgtccatcaacggatgactggataaagaaaatgtggtaggtatatacaatggaatactattcagcataaaaaagaatgtaatcatgtattttacagcaacatggatggaactggaggctgttatcttaagtgaaataactcagaaacagagtcaaatgccacatgttctcacttacaagtgggtgctaaaaatgtgttcacatggatgagagagtggaattatatatatagtggagactcagacaggtgaggagctatggcgggggtagcatggtaaaaaatttgttaatgggtgcaatatatattagttgggtgatggataccctaaaagccctgacatgacttcataatctatgtatataataaaatcgcacatgcattccacaaatttgtacaaaacaaaacagaaaagactaggatgctgaggtagagacaaatctatgggaaattcccagattaagaaacaatttgaaaatactgttttttcaggctgacttcaaatgtccagtttcttgattcatttttcttttgttctcaaaaccttttagcaattattgtttcttcactgtttcttttaatccctttctctcaaactcgtattacatgaatattacagcctttcaatctaccttatatgtcttttagctgtggtaaattaaattgtttttttctgaccccgtattgagtttctggtaaatgtatcaggactatccggaattttctcttcaactctatctagagaagattttatttcatgtactaatttatgtttatttcaatgactgtatttttattttcaagtttctaattggattctcttcatacatacatttctctcctgcttttgtttttatcattttctgttcatttttatttgatgtttcatctgcatttgtctttttgaacattcggtatgaacatatttttaaagtttttgttatttatttctgtaaaattaatttcatattgagcaaattcaggttctgacttttcttctggctgtaatttttagcagcagatttctccatatgattttgaatactgttttaatggctcgttttgagtggaagatgtttttctgcggttgttttctctcacttccttctccctgctcatacctgtctgtctttgtctttcatcttgaccctcctgtccccagccaaaaataatttttcttctatcaccagttatactgtacacatggaagactctttcacagacatatgtgatactttggttccgtttctaacagattaatagtatgtcagctgtccttccccccaccccccaccccaggtatcctcaggcaagcagtttgtcaaaagatataagtggaggctggcacacacgtgcatgtgtgcatgcacgtgtgtgtgttctaacctgccttcttagagacaagtgctggtgtgctctgtcatttctggttaagttctatcatcaacaggctaagtttcctttttcttctttatacaatttctgtttaattattggcaattgaggtgtttatcttgcttttgaactcggccctgccttttttatcttttcatatgttttatatgtcctggccatgtttttggtgtgcaatcagtgattgatggttcactatcatgccatcctgatttgaagacaagtttctaagttagcagattttcaaatatacctgacataactcttactgattctaagtggacaaggaaaggcaaggaaaagttaggattataaatctaatgtaattcacttgctggtcctctgcagtagataatatataagtggcttgcttattgataacttgcaattgcttggcttcattctgaattctgtaagttctccaaaaattcctgtccccaagttttctaagcactatagtacaatcagaggagaattattagcccagaagtctaatgtcctggagcctaggtgggtgaatctgggcacttttgtatttcaatttcctcctttataaaacaggtataataatgtctacgttcaccttcatatggagttgttgaggacactgcagagataacagagtgaaattcaacaaagttttacttagcttctgtttggagacagatatattgctaggtctagggaaataaaaattgaagcatagccctttggttatttataatactgtggtccagatcgcctgttttattatgagttgtgacaatccaatgtggactgtggtaaacactaaactaggtataaacagtgaattaagaccaccctccaaaaggagcaattcgcacttgaggaaatgagtgaaaacttcacttagtaacccatctttgatctaaagtcctgtgaaaatgccaagatgctatgtaaatgtaagatgtgctattattttattttatataccaaagttttctcatgagtgaatctgactggagaccacttagccattttgtctttttttttgtttgttgtgtaggtcggaccttgcacttaaatcttccatcttctgggtcctggtgcttgtcagtcaatcattctctcatctgtgatggctaattttgatgtgtatttttgaaaatcttctcctccaggctgcttttcaatctgaagttccaaggaaacacccattttgctattatccagatacaatttagactgagccgttgcagtagaacattgtgttctatttgccataattttttttcaagagacaaagataaacagcttaaacagataaccatctctggttgctgattttaacaataatatttagcagccagtgaatattctgcaagtgcctttctcagaaaggctgcattaagtaaacaagcagtaaatattccaaatgactgagataatagaagttaaatttagttagctaactgcccatatctggctaaaacattgtttttctgttatggtaaataatactcatcttgtttagacaggttttatcaaaaacagtgttagtatttcataccaaacatatttttatgaagctcatgaagcttatgagggctaaaactaacaaattttgagctgcttcagtcatatttcattagttttctttagatgtatattttgatttatttccaaatcacaagttatactgtatcctgtgttttgaagaacaatagtgactggagtattccaattagtcagcattttcagtaaaacctgggttgtttctgccattgaaatatcagccatgaattgaattggtattttgaaacattttcatttgattcctggctgccaaagaatgattttgttgcaggtgttttttgagatttatgtacttaatatgtggtaggttctgtatcacatatcgttgtaatttgaagtgtcaaagtgtcatttcctttgcaaactttaatttttttttttttttccagacaaggtctcactctgttgcccaggctggagtgcagtggcgtgatctcagctcactgcagccttgacttcctgggcttaggtgatcctcccacctcagcctcctgagtagctgagactataggtgcacaccaccacggccggctaattttttgtatttttagtaaagacaaggttttgccatgttgcccaggctggtctcaaactcctggactcaagcaatccgcctacctcagcctcccaaaatgctgggattacagtcatgtgccaccatgcccagccctctgcaaactttacagcaagagtagtctaagagatgtggccattccacagaaaagagagttactatacactatatccacagtgtcttcatctgtttattattgctataaaggaacacctgagggtaggcaatttataaagaaaagaggcttattcagctcatggttctgcaggctggattgttcaagattagccatctggtgagggcctcaggctgcttctacccaaggtaggggaagggaagccaacatgtgcagagactacatgatgagagagaaagcaaaaaactgaaggggaggtgtctggctctttataacaaccagctcttgctggaacttaaagagtgagaactcacctccccatcccctgcagaaaggtattaatctatttttgagggggtgtacccccacgatccaaacactttccattagggcctcaccttcaacattgggatcaaatttcagcatgaggcttgggtgggacaaacatccaaactatggcaatcagaataatgagaaacaccaaaaagtaaacttccgcagggcaaggattttatctttctcattgtatttttggatcctaaaacaggcctctttgcatatagtggttgttcaataaattaactgaaataattatcatcggccccaagatcatcatcagtatttccattgcttatgaaaatactgacacatagaacctgggtcctgccctcctccaaaagacggtcttaaaaaaaatgtataaacttagtgggtacaagtgcagttttgatacatgaatacactgcatagtggcgaagtctgtacttttaatgcaacacacatcacccaagtagtgtacactgaacccattcagtaatttctcatcctttaaacccctcccacctttaagtctccaatgtctatgagtccacactgtatgtccatatatacaccttgaggtacagtaaaaatgtgacattaatcttatgaaactaccatcatatatgcagcccgtcattgactggaaaatcattatgcagagcatgactgtacttctttagcctaaacaacctacatgccaataaaagtttcactgtttcttgattctgtatctttcaaaatgtttctttcttcttgaatgcctccctcattttccaactattcatcaaaatagtataaattgttcaagtgatgggtcaatctttttctctattccctgacttaccttaattaaaataactctattacatccacggatacccagagtactttatttagtacctcttgtaaacaaatattgtatgtatacagggtagttacataccaaaaaaacttggaaatgaaataaataaaggtgttctccaagataaaattttaaacattaacatatatttcaataaagtgtcatcttttcaaaaatttctggtccacaagcctggtccacaagccaaaccaacacaaaactaacggcatttacttaaaaatatattctcaaaagaattatattaagtagaaaggaggtggggagaaatgagaaatattcaaatactcaacaataaaaactcagtgagtataccaatagtcacagcagtattgttcataatagccaaaaggtggaaacaaccaaaatgtccatcaatagatgaatggataaacaaaatgtgatataagcacacaatgaaatttatttagtcttaagatggccggaaattctgatacatgccacaacctgaatgagcttggaagacattatgctaagtgaaataagccagacacaaaacaatacatattggatgattccacttatacaaggtacttagaatggtcaaattcctagagacagaaaatagaatggtgattatgagaggatgaatgatgagggaaatggggttattgtttaacgggtacagcatctgtatgggctgattaaaagttctggggatggatagcagtgctgattgcataacaatgagaatatacttaatgccactgaaccatacactttaaaatggttaaaaaggtatattttatgttatatatattttaacacagttatataaacttagtgaaggaagagttgacaggtctcacccaaacactgacacaggtacagatgacccatgtccatcttatagatataactttaccgtgaaaaataagcacataaaactattagacgctgggcgcagtggctcatgcctgtaattccagcactttgggaggctgaggcgggcaaatcacttgaggtcaggagtttgagactagcctggccaacatggtgaaacctcatctctaccaaaaatacaaaaattagccgggtgtggtcacacacgcctgtagtcccagctactcaggaggctgaggcaggagaatcacttgaatctgggaggcggaggctgcagtgagccgagattgtgccacagcactctagcctgggagtcagagcaagattccatctcaaaaaaaaaaaaaaaaaaaaagctattagaacctagtacaactaaacaatcaaaacagtaattcccctcttcctaagttccaagcatgaggccagaatgctaaataaaatgcaattccttttttcttcttcaatttccagctccaggggctatgaacaaggagtttctactataaaacgtaacttataatattgcaattctcacacaccaaaatccaagaaaatggtatctgagaaataatttttgaaaactcaacagcacaccttctagggattgatacagctactaagtatcacagaatacctactatactcaagatactatgctaacaaattaagtccaatgaagtataatactatcctcactctctgggaatacaatgcagtttgggactaggtaggtaagcattaaaaactatatacaatatgaagcaacatatacaaggttcaaaatgagtggcacaaacaacagattttaaaggagctaagacaagaaagaaacctccagaacagacatgatacaaactttcctataaacttgcctatagatttcaagaaacatcagttctctacttgattactgtccttctccacagaagtcttccctaattattctagcctctgtatgtcatttgctgtactctacactataacctatattcaattttcttatacaccagcttgtcaccataacaactgagctaacaaagtacattattaagtataattctgtacataaagaaagtgctccataaagacccaatgaactgaaatgaatgcttccgttataagctctcaggaatgttgcctgcatacataataaagcaaacaattactagttaatgtctgtaatacagataattttgggggtagggaggctgcatagaggaggaactgtatctcatcatttattccactccaaaaagtattggcattatggatatggcaggtattcaaccattacttgctgcctttattttgagacaattctatactttctaggtgacccagtacataattttgtggtttcctgcacaaggagataaagaaagcacgaactgatctaaaaccaagacaactgtcggttatgatgaaatgttagttcttggtagatttctaggagtttttgagttttgcttccctgatttctcttacttggaagaggcccagaagttatcagtacaatttggattagtcaagtaatagtttagctgaatttatttgtactgtaaaatgtaacaactgtaatctgatttttaagaactttaaaataattaaacatttcaagactaccaaagataaactcacctacaaaggaaaaataaagcaaaatatgatctgaagacaatatttagagaaaataactcttccaatcacttataaaagtagagaaaaagcaaagttagtaattttgagaaacagaaattaaaacaagtcccaagggaacagtaagggtctcaggccctagaaagatccatcatttggcaatcaaaatgattactaatatgctaatttttttcttggagataacatatacatgattttaatttttctagaaaatgggtaatttttattgttatatttagttttaaaacattttaccctaaaaagaaggactctgtaaatataaggccgaagttgtaatttttgcagcttatgtatggctgtgattagctgatgaatgaaatgagaagtgaaaaactttgacttgcctaagacagaatctgattttcccatacgattatcagaaaggagtatatcattaatcatttgtgctaccatgcaatcatataactccactaagccatttatcacagatctgttttcgctaacattctagaactagaaattaattctggcagatctaagtcaatttgctatctgtacagaagccgtaatttctattggtgaaaggaatgaaagagggtacgatttagaggaagagaacatccattaatgctaaaataaagggatgacacatacacacgcatttaaattcaagagttaactaatggagcttgaccaacaccaaagtgagagagaaagaacatcatgaatgcagtgtaggcaattttacttgatattcctctcagtaagattataccctagaacgagcataagattcaaaacaaaaacatgctatccacagtttacctcaatttaggaatgccttttaggaaaaaaaaaatagaatacatttacactgtgtatgattcaagtattgaagtcacaattcctcattttcttttccttctttctttttttttttgtttgagacagggtcttgctgttacccaggctggagggcagtggcatgaaccctgatcactgcaacttcttcctcctgggttcaagcgattctcctgccttagcctcccaagcagctgagactgcaggtgcatcccaccatgcctagctaatttttgtattttcattagagacagttttgccatgttgaccaagctggtctcaaactcctggcctcaagtgatccaccagcctcagcctcccaaagtgctgggattataggtttgagccactgtgcccagcctacaattcataattttagatcaatataaactccaaatatactaacagcttcatccagtggtcagctggaaaaaaaaaaaaaacaaaaaaaaatttcttccaatcttgaaagaataagctgctttagatgtaagatttaattttatattacctctgtaattatacagataatttatcaatttcttaagacatccttggtaataccagattttttccttatgtgttaactttagaacccagttatcacatacgatgtacatatatgtactaaaaaactatacatgataattaacatatgctaaatatctatctagttttatttcttaaagcaataaataatagatatgtgacttctagtctcccactaaactgtgattgtttcaaaaataataacttttaaagtacattctcttttgctaaatacagaaaggttagcctgaaatacctttgtgtacagtaaataccaacttgggatattctgtagtggagcgaaatcttgaaaaactgtaggaagataggtaaataataccaacattcttgtcacaaataaatcacaaactacatacagtagttaaatagacacaataaagtttagacaatcccattcagtaatggtaaggtggcataaacattaaaaagcattaaaaaatacaaacaaggatatttggtaaagcataaaatttggaaagtacttctcagagtttcctaaaagttcctataaatatattaacttttggccgggtgcggtggctcacgcctataatcccagcactttgggaggccaaggcaggtggatcacctaaggtcaggagtttgagaccagcctgaccaacatggtgaaactctgtctctactaaaaatacaaaattagtggtggcgcatgcctgtaatcccagctactcggcaggctgaagcaggagaatcacttgaacccaggaggcagaggtggcagtgagctgagatggtgccattgcactccagcctgggcaacaagaacgaaactccatctcaaaaaatatatgtatatatatattaactttttattcaaaataaggcctgtaatttcccacttccatttagaatcattttcaacatatagacatttatttttaacaattaaacctgactgcctataaaggttgtgcatatgagtctgtgggtatgtgactacatacagtcaaaaaaattattttccctactacaaatacacacagattttttttttttttttttgagacagagtttcactcttggtcttggctcactgcaatctctgcctccgaggttcaagtgattctcctgcctcagcctcccgagtagctgggattacaggtgcccgccacgacgcctggctaattttgtatttttttagtagagacggggtttcaccatgttggccaggctggtcttcaactcccgacctcaggtgatccacccgcctcggcctccttaaagtgctgggattataggcatgagccaccgtccctggcccaaatacatacagattatatctgtattaatatcatatgatttttgggtggtggtaacggggagtgggtatcactgacaagccttcttagactcatgaagcataaaaaaaaataaaaaggaatcccacacaatcacatttttaaacagcataggttatggccagctgagaaaaaaaagaaaaaaggaaccatcgaagccataaaatatataaaatatataaaatatatcctaccttggctttctgagtagctgggactatacaggtatgcaccaccatgccgagctaaatttttttttttgtacagacaaggtcttgctatgttgcccaggctagtctgaagctcctggcttcaagcaatcctcacatcttagcctcccaaaaagctgggattagagacataagccacagtgtcctgcctatatttggtttttaaggagtacaataatatcaccttcaagttattgtaaacatttaaatagtaagaaaatattatcaacaatgaagtaataggatttagtctgtatcagcactaaaatgacaactcctgatgtaagaccagagggctaaacatgtgcagagaatgcaagatatcacttgcacacaaacttaagatacataacatagaaatactttaatgaaaacagatttaaacccacaatttagtactttcaacagccaactatgacagtcttatacatttcttccccaaataaaaaggaatatcactgaactccacaagcttttttaaaaaaaatcaactgctgctaggtgtaataatatggcatagagtaagaaaatcaaagcacatggtatatttgatgagtcatgttccaaagaaaatagtccattttttaaaaaggtttaaaagaaagttccatgaggataagaagaggattcaagtttttgtctcagagaacaaacggattttaatcacacatactgattttaatcacacgtactgcttttaatcacacgtactgattttaatcacatattacctgtttctagacttaatgaaccttgtattacacagttgagcaaaatgtcccaaataaaacagccatatagagtctcagagcgggggaaaaaaagaagtatgctaacatcagaagaacatacctaaataaataaatgttatttttatttcaacctgccattgcttagttactttaactaagtgactattcaaaagtaaactgaaccaggagccacaaccagtgaactatttcaaaagtaaactgaaccaggagccataaaatgccctaacatctaataaatacaaataaaccatgccacactgactcaacacaaaggagaccttcataaacaaatctctccatactttaaaaatatttggctaaatagatgctagaggtttcctaaaacaagataattgtatttttctacatgtcagctagtttatcatcaagttttaggtatagtttacaaacaaagatttaaaatcaaaactacctacacattaataaacaatacaggtgaatcaagattttgctttgattgatatataagatttagtatataacaaaataaaatattttccctagaaatatgtatttttaactactcaatttgattagccttataagtcaaagttctgtaaaaaaaaaaaaaaaaaagtaatgaaatgagccaaaaggtcttacttatctctattactttatcaggaatcagctatttaaatctaaattccttgctgtccattacacaaggcattaacaatattgttatcataacaatactttaaaaaagccttacgagacttagaataaagtaattatgcaagtacaaaataacagaactgctcaaggtctggaataaatattcacaaaatctcatacaagcggtgtcttttaaaaatattacttttctgataatgtcaaaaggcacctcaatagtacatttgtgacaataataatgcacttttttatcaccttgcaatgagtcattactttttctcataaaacttaagggaaaatattctcttataaagtacaaaacaatttgctttccaaattatagtgctaatcattcattttttttctgacaccactacaggcagcaacaatagaaattaagagaaaattggacatgtatataaaggatgaataaagaaataaatgcaacacatttacactattcagtcactatgactttctctagaacctactattctcattgctatggtctaaaaggcccctaaaattcatgtgttaaaattttatcaacaatgtgatagtattcagaggtgaggccttcagtagatgattaagtcatgagaatacaaccctgatgaatggaattagcaaccttaaaatggagcttgaggaaatgagttcaccctgtccgtcactttcgccatttgagaacacagcattctctcctccagaggatgtagcaacaagcacttgacaacagagaacaagccatcaccagacaacaaactttctgcaacctttaagcgtggatttcccggccttgagaactgtgaagaaataaatatctattctttataaattactgtctgtagtattttgttataaaagcacaaacgggctgacacattgacacaatttggttctagattaaacaggtaaaaacgaggcagtgaaacagtattactttccaggcaagtgcctgtctattcaggcagagaccacgaaacaaaattaacaaaatttaaaatattccaaaacacattctttaaaaaaagcttattagaaaggaaatcctcaaaaatttggcatcaagatgtagaaataggaaatttcagccatcgtcttcctgcagaaacaatattgtcaaccacccacagatgacagtagctttgtgggagcccaaaagtccagcagatatggccaacaccccagtagaaaaaaagcttaaataaatagatgcattgaaaagggtaagaacaatttcactttagctatttcttcatccctcccctaaagccgcacagcccagtgccaagagagatccaatcagccttggatctgtctcacaaaggaaagtaaaagcatagtgagttcctgtcttctacagctctgagagtcactgcctaagaggcctacttctttctcaccccaccgacaacacacagaagactcggaggagaagctagaaacaggagaaaagggtggggactcaaaacaactagggcacagaacgcaacaaagcaccatggtttctgctaaatgcctcccacactccaccaagaggtattcccaagaacatctcacctatggtcccatctgccaactaggctatatgttcccctaacataccatgcacccctctctcctgtacatggcaccctatatgtgcccctgcagacaatacatacaagcatccacagacttggtttgattctgaacatttcaggacactaccgtagagaaaattaaaggaggctctcaacaatggacctacctttgcaggattgagagaaggaatgtaaacctaagatttcttccctgaaaaagggaagaagtagagtagttatatccacagaaaaggtctgaaggacctccagaatccccacctcagctgactggtgaagtcttttctcctgaagccagtcactacagagcaaagaagataacatcttctttgaatgtgaagatggcaaggcaaggcttcaaggaaaattaaaaaaaaaaaaacaaagaaatatgataccaccaaagaaacaaagtaaatttctagtaactaacaccaaagaaatggagatctatgaattgcctgacaaagaactcataataattgtttaacaagctacaagaggtcacagacaactcgatgcaaccagaaaaacaatatatcaacaaaatacaatcaacaaagacaaaaaatgcacacacacacacacacacacacacacacacacacacacacgaaattctggagctgaagaacaccataaatgaaataaaaatgtaacggccaacttcaatatcagacttgataaagaaaagaaagaatctacaaactcaaaaacaggtcatttgatttccagtcagaggagaaaaagaaaaaaaaagaatgaaaaagagtgaggaaagcctgcaggatttatgagacaaaatgaaccaaaccaaaatatgcatgatagaagtctcagaaaaagaagacaaaaaggatttatgggacaaaatgaaccaaaccaaaatatgcatgatagaagtcccagaaaaagaagacaaaaagaaagaagcaaaaggcttctttagataaataatgccttaaaactatccaaatcttgagagagatatggacttccatgttcatgaagctcaaaaaatcaagaccaatccaaagaaaattacactaagacatgtgctaatcaaattaccagaagttaaagacaaagtaagactttgaaaggagcattagaaaactgactcatcagagacaaagaaacaccaattagcctatccacaagcttctccctaaaaatgttacggaccagaagaaagggataatatattcaaagggctgaaaaaaaccatgtgaaccaagaatactataactagcaaaaatgtttttcagaaatgaaagagagattaaaaactttcccaaacaaaagctaagggagttcaaaaacagtaaacctgccttacaagaaatgctaaagggggttctttaacctgaaacaaaactattctaattaataacctgaaaacatgaaggtataaaactaactggtaaaggtaagtagatagtcagtgtcagaatattacactataacgatgatacacaaatcatttttaactctggtacaaaggcttaaagacaactattaaagtgactatagccataataatttgttaagtatattaagataaaaagttgtacattgtgacatcgataacaaactgttggggtggggggaataaaagtgcagagtttttgtatgtgagggaatttaagatgttatcagtttaaaaaagactgttaaaactataaaatgtttgatatgtcttatgaaaaccaaacacacacacacacctctaatagaaacaaagagaaacaacaaatagaaagaaatcaaagtatgccactataaaaaaataaagttacaatgaaaaacacaaaagaggaagaaagaatcaaaggacctacaaagcagcaggaaaaaaattttaaaaaatggcaatactaagttcttatctatcaataattactttaaattgcaaatgaaactaagttcttcaataaaaagacaaagtgggtgaatcaataataaaacaagacccaactatatgctgccaacaaaagactcattttaactttataaacacacataggctaaaaggggatggaaaaaggcattttgtaaaaatggaaaccaaggagacagatttgagtaattataaaactccaatctcctgcaaaactggctctgtgttaattactctttctctactggaattcacccatcttgataaattggctctgcctaggcagcgggcagggtgaacctgttgggcagttacaaatttggaggctcgtctgggattgcccttgtggctgcctgcctgtggttcagtagccccctctctggtgatggatccaaaggccagcccaagcggccacagttgtcttggactgggggctgattctggcaatctctctactggcagggtgctgccaatccaatgtgcatgaatttaactgcaatagagaaacagtcctggggagacgtcccataactgtagccctaccacagggtgtctgtctgtagctccatggcagggtatatgtctgtagcctggtcatggagtgcttatagctgtagccccactatgaggtatctggtttggtgagtatcctaggtactgcccacacctccttccttctcctgatcagtttggatccttcaggggtgttggtttttctgtagccccatggtggagtatccgtctgtagccccactgcatggtgtctgtcttggtttggctccatcaggggtcttggttttcctgtagccttgtgtggaggtgtctgtagctccactgcagggtgtctgtcttggttcagcccctttgggggtctcagttggctctccctaattagtaggaggagtcttggttcagcagacatctaaatcaggaagatttcagggagatttctcagacggaaaatagaatagtttagaaaggatactctcggagttcttggttagggatctggatttggaaggccttctgcctatcgtgtctttgtgtgtgtgtttgtttatgtgaagggaatctctggaggaattgctggcacaagttcagcaggcctaactcagagaaccctccttatttgtctggtcacattcggtgagccctgaaggaagctcaacaggcctgactcggggagactatccactcttcgtcttacccagcaactacccaatgaattaccattcggaggtcatccctccccgcctggagtgaatcaaaggcaacagggaccaacaggagaaagctgagccttgccagtttaatactgggtgctgaatgagttgactagtgtctgttttgttatatgtattttgctttggctgggatggaaaatgttaactcagttccccacacagtctgttgggcagcatcttgcaaaattgagaatcttttgccaatagttccataaaacagaaaagggtgatttccttttgtaaagtggcttgacccccacagctatgccacagtaagcagggtcatcaaaaaccgctccatttttctggaagctgcagtgaaatggaacccggaaacctggtatgccggcaaaaagggtaagaaattcttaccagtcaaaagtttctggtgtgtctctctctctcgctctgtgtgtgtgtgtgtgtgtgtgtgtgtgtgtgtacatggtaaatgtcaatatttatctcctctgcaagggtttaattaatagaaaaaaaggatttgtgagactagtcttaggctgcagcaaatctggtgcgctttgtgctaagaatgtctttcagtgtcgttctgtaatggagagagaggtatcacaggatagaacatgggtttaggacccctataagcctacctttcaagccagcctggcaggctggtcagttacaaactttgctaggggtccctgaaaccaatactagatgaaactttgtcttgttttatgtccttaagagcttaaccttgtgaccatgtggtgatactctctcttggtttccaccatccagaagacacgtgattttagtaattttctgggaataaagacagttttaaagactactggtaaaattaaaagtcctccaaatttagacatttggtctaaattaaggtcaggtatcagatttgctaaatgctttaaagtcataaactgcttctttgacttttgaaaattgttcagtttacctaatttggagcattagattctagataaggcctgggaacatgtggagttagcctggctccccagctatgctggaaagagtaagacctcatctgcacttctgtctgatgtcttaggctccacacctagtacataattaaaatcacttatttatcagctttttcatcaaaaataaaagttgctaagagttaaacactgtaacatgtaattgagactactggagaaacagcttgacatacaaggttgcaaggtatagaaggaaaaagtagaatatggttttgctgggagatcaaaagaaggcatggggatatggttttcgtgaaagacaatgtaattttgtgtagttcagagggttttaaagattgtctcaacctaaaagagtaatgggacaaaactgaaagtttaagcaggttgaaaagggtgtgtgaagggttgatcctgtaaaaaaagttctgggggtataagcaagttggctaaggtttgaagggtattatttttttctgcaggttgaacattaaaataaaagcacactgatatggggccacagtctgggcccatgtgtctgagtaacagggttttcttagaaaatttatctgctgtttaacagaaaattataaagagatctaaaaagtttatgaaaatcttaccttatggtaaaactaataaaaagtggatggatttataaaattttatttaaaaactagctttagcattaaagatgcactaataaaaacataaaatttttctcttttgaaaaagatttttatgtaatattgagagacaatgaaagatttttgcttgccttttgagtaaactacaaaaaatggggagagagaagaaacagattcagttggcctcagggtgtcttcattgggtctaatatattgtttgaaaagctgagtctcctaacagagtaaacgtttttctttttaaaaatttttgagttatcattttggccaaatgaatgaattatgatgacctgaaattctattttgtgatatccagtgttttaaacctttgatatttgacaaactttccaatatcaaattatgaagtatgcatttttctgacctaattaatcttttagatattatgtcctctaaagaccaaaaacgacacacttggtttatttggtataaaaatcataaaagaaacactatcaaatatgaaatggtgtttggctttctttgtgctatatttgtgtaaatgtgttattggtatatgttgcaaaattatatgaaagtcataattctgatatgacttagtatatggtaccagtaataattatgttaaattattgtgtgccacaaaagtaacaaatttccttgtcaattttgtctttacctgtggctaagactttttgtcatccacagacaattgttgtcttgctttgatcctctttaaatggtgattttataatcagctgtaaaactctaacagatgttcttaaatgcaggtttctgataactttgaagatggcaacagtagaatgaagggaaataacttttaggactctcatggagagctgatatgttcatgaatatcaagcaaaacaggagttaactgaatggactgaactaacagataatgaaggccaggtgcggtggctcatacctataatcccagcactttgggaggccaaggcaaaaggactgcttgagccgagatagctgagaccagcttgggcaacatagtcagacctcattgctccaaaaaaccttttaaaattagccaagcatggtgatgcacacctggagtccaccctactcaggaggcttaggtgaaaggatcacttgtgcccaggaggtggaggttgcagtgagctgaaactgcaccactgtactccatccatctggggcaaaagagtgagaccctgtctcagaaaaaaaaaaaaaaagagagagtgccatttccataaatgtgtgaattttccaattttacttctgctagtgagtctaacttcatcctgttgtggtcagagaagatactttgtatggtatctcttcttaaatttgaggcaaaaatttgtgtcctaaaacacgatctatcctggaaaatgttccatgtgtaactgagaagaatttgaaaacaaaaaagaaaaaggaaacagtaccagccctttaaatcccctggaagtcacttgtcaaaagaagagcagtttgaaacaatggtggaaggtataacaacaatggctgcccacttctttgtctggaaatctgagatcagaagcagcaatcggcaatcagagcacagatccccaatatttggagaacaggctcctaacttccgcaacgtaggtgcaaactgctccaggaatatgtacatggctgcctatcacggggctgggtgtgagagacagggagctggtactgtgctaagagctgaaactgaccaaaacaaactacatttatcatctaagccttttcttggaaactgtaagcattaaacagtctccagagttccaaaatagtcacattagattctaccagtgcaactgttgtctaggtggggagacagattcttattgcttcctactcagcctcttcccataatcctccaatagattttcttaaataagttttcctttatttgctatatgaccttaggaccatttccagagacttaaaatacttgtggagcatctcatgctatcgtttcagaagtcatctttgactatattattttctcttcttcactgagtattaaacaagccttgcattcctggaataaagtccacttggtcacagcatatgatctattttatatattgctagattcaaattgctaatattttgttaaggatatttttatcatcttcactgggaacactggcctttttttccccctgtaatgtgtttgcctgattttaaggtgagaataatgctggccttataattagttggaaagtattcctcctcctctattcactgaaagactttgtgaacgatgggctacagatagattagcgctgtaagggttcaaaagaaaacactgtgtcttgaaaggactgatacagttggtgaaatctgacctgcaaaagccagtcttaggagagaggggtgaagaaataccataactaagggaacaaatatgagaaattttaaaacaaactaaggaaataagcagcctactttgcttaactcagcaacttctggtacattggtaataagctactaaaacatgatgatagaaagaaacatacaaggaatttatatctccaattttcaattacttcgtgaagaataatcacaccactataatcttactaaatagattaagtaaatggattgtaccattcttgtacaatgtaaacatggtatcactacatgctatgtaccttttaaataacagagcagaaggcatttgatattcttttagcctgtgaaaaataaaagctcacttttttatatttagagaatatccagtgtaaggccatttcactaacatatgctgtaaatgtcaaacacttgctctcttagtcttctttgcagccagggaaaggcacatgacctaacctgtatcgatcagccatcagctgaagcatgaatgggtaaccggaagcaatagtcaaatccaattttcaaagcacattctggcagattctatagctatatcaaactctaaaaatacaatctaatgcatagtgacagaaagcatatcagtgatagctgacagagggaggtgcatggagaagagcaggagggagattaccaaggggcaataggaaattattagagttgatgaataattgcattatcttcaaaagtgacttcataggtgtttagatatgtcaaagcttttcaaatgtgtgtagttttattttttattattattactattttagactcaggaggtatatgtgcaggtttgttacatgggtatattgcttgatgctgaggtttgaacttctaatgatcccatcttgcaagtagtgaacatagtacccaataggtagtttttgaacccttaccccacttcctcacttccctctgtagtttttaataggtgtagttcactgtgtgtaaattatatctcattatacctttttgaaataaagaaaataaagaaaagacagggaaaaacctttgctacaggggtaaggcaataatcctttagatacacaccaaaaaacacaactggccgggcacagtggctcatgcctgtaatcccaggactttgggaggccgaggcaggcggctcacctgaggtcaggagttcgagaacagcctggccaacatggcgaaaccccatctctactaaaaatacaaaaaaaatagccggacgtggtggcgtgcacctgtagtcccaggtggcgtatgcctggaggcatgagaatcgcttgaacccgcgcagcagaggttgcagtgagccaaaatcgcaccactgcactccagcctgggtgacagagcaagactccgactcaattaaaaaaaaaaaaaaaaacccacacaattaaaaaactaacgaaattgttaaacctgttttttttgaaatacacttataaagtaataaaaaagccacagattaaaagaaaaatatttgcaaatcatgtatctgaaggacttgtatccagatagattttttaaaatctctaaaccaagtaagaaaaatctaatttaaaataaaaatccaacttaaaaaatgggccaaagaattgaagaagtacttcaccaaatgagatatacagatggaaaatgagctcataaaaatgctcaatattctaattcattagacaaatggaaattaaaaccacgagatgccactacactgtagtccaatggttaaaattaaaccaattgtcccttcctagatgttagtaggatgtggaggcaatggacctcactctacttgaagaaatggtgtacaatatatttgaaaaatactttggcagtttattccaaaagttaactatatacatatacatacttaaataagtccaggccattcagcttctacaaatttacccaagggaaatgaaatcatgtgttcacacaaaaacttgacacaaatattcatagtaacttaatttataatagccaaaaaactaaaacaaccgaacattcatcaacaggtgaacagataaagtgtggcatatacatataaatggaatactattcgtcaataaaagatgaattattaatcaatgcaataacaaagacagatctcaaaataattatactgagttaaagaatctagataaaaaagaatattgtatgactccatttaggtaaaattctatacaatacaaactgatcttgtattagtttcacagggctgctgtgacaaattaccagaatcttggtggttttaaacaacatagatttattctgttgcagttctaaaggccagggtccaaaatcaaagtgttggcaggattggttcattctggaagctctgaaggattatgtattctgtgtctcttgcctagcttctggtagctgccagcaatacttggcattcctttccttctaaatttattattccaatctctgcctccatcacatcacctcctctttatgtctcctcccctctcttctaaggatatttgacattggatttacggcccgtcctaatacaggatgatctcatctgaaaccctcaattacatttgcaaagatggtttttttccaaataaggtaccattcacaggttatggatagacatcttttggggtggggacaccattcaacccactacaaagctctagtgacagaaagcaaatcagtggttatctggagatggggagggattagaggaaagaattgcaaagaggcatgagaaaacttctaaggtgatagatatatccactatcatgattgtggtactggcttcatggatataaatgtatattaaaagttatgaaagtatacgctttgtgacaagaatatgataatttctcatgcctgagtctccggatacagccatcaaatataacctaagtaaccataaattcaaacacgatagaacaaatagttttaaaaagatgtggaattgagaaaggatagcagaacactgagctataaattaataaatgacagaggctaaggaagaatgagttctgctaccccaaaagggaagacaggtaaatcagacagtttacaattagttccctgagcattgtcttctacatagaccctaaacaaatactggtggagtgagtcaatggctcaatgaagcactaattcagagttccctgtgttaactatgaagtggtatttatagatccagggcagtttgggtgcttgttggaacaaagtaaggcacacagaacctcaaagaaggctgcaaaaacaaacagtaatagttaactttttttttttttttttttttttttttgagacggagtctcgctctgtcgcccaggctggagtgcagtggcgcgatctcggctcactgcaagctccgcctcccgggttcatgccattctcctgcctcagcctcccgagtagctgggactacaggcgcccgccaccacgcccggctaattttttgtatttttagtagaggcggggtttcactgtgttagccaggatggtctcgatctcctgacctcgtgatccgcccgcctctgcctcccaaagtgctgggattacaggcgtgagccaccgcgcccggccaatagttaactttttaaggggactgtatgtaccagtacgacaaaccagatttctatagtaacattagcatacataagaccaaataaattaatgttcccacttaactctcatttgccaagaagaaaattttacatggtgcagactaaaggaggaggaaaagttagaagaaagaataagaggaaaagagtaggaacctccaaaggctggccccttccaagcctcttacaatatctacaatttggtgatgcattggaaaatatgctgaacataaaaattcctgccatattatttagaaaccgccaaattaaatacatatgcaaaaggcatttttttctattccacagaaagttcaaaggtatgtgtgtatatatatatatatgcaaatagctctagatttatctatgaataaaccttataatgttattatatggaaaatatattacatgttaaaggaccaaaaaataatccttgagaaagatcaaacatcttctttaatgagggagatttattaagcagcaaccatttgttctagtgtattgagtttaattcacatgactagcagcttgatttggcagtctcaatgcataagacaaataattcataaaagtttgacagtattatttttagctcgcatgcttcttggactcagcccacaaatgctgctgctttatgctaccctagggactccattcaaatacaaatacatttgttagcaactgggaggctgagggaggcactcagtgcacacaacatgatattctgagaatccaaatttatcatctcatttgggtagacacttagaataattaaaaaatgactgttgttgcttctacatggactcaacgaagtaagatggtataatttaggccacataacattatgtactagaagcatgtttctagtaaggattatggttaccaatgatcattacctagtaagtttaacagtttaattgatctctctttcataaaacaatatttgagaatggtcacctaaaacatcttgttaaatgtaaacagtgttttcacataccttgattatattatgaagcacaaaacatttttatttttcatgagggagaaatatatctaaaattagaacttaacacaaacatgtgaatcaattgtttctcaactacttccaaacaaaatatttcaaattccacacaagattctgcaaacccatgagtacaagctctaatcttgacactgaatttggatcatctccatggaggaaatccatgaaccagatgtggatttattcgtccagatgtatttcacatgtatgaggaaaaataaaacatttcttcactgcctttatttgaggccacttaaaaatacactagataaaaatagcaaaaaaggaaatcctacaaatcttgaatcttgagtcttccactattctgaaggaatcatttgttgaattattactaaattaaccaaactacatatcgagtagttttcatattatcaatgcacattaaagttactagtaaatcacaatcaacttaacatcatttttataatcctccatttttctcggtattcagtagccatactaattaaaatagaaaattttaaaacaatttttgctttcacattatttgcaaattaaagagaaaaagtattccttcagttttaactaaaatgtcatgacttcaagatctaaaataaacttctatgcacaaagaaaacatggatctacaatggcaaattaatgatcacaacaaaatttcataaaattagtaatacacctggatctaattgtatggtctcaaaatttcaaattactttaaaataccaatgacacgagttttaaaagctataaatttaatatcacaaaaccaacctccatcatattaagagttcaactaactagaaaaaaacaaaaatggttctgttggcacatatatttcctttgccctctactagagatccttcaaatgcttaacaactctatttaaatgttaaagaaagtcaaatcaggaaaatgggtgatctagttgaaatgtttaattttacccaggaaaagaatgtacacatatactatttagttataataattgtaaacagatataacgatacttattttatatgaaaatgtttaatttactgagacacagtagctagtcatatatcaatgcaaattacagcagtacagatatacacatacgaccacattaaactgaaacagtagctagtcatatatcaatgcaaattacaggagtataaatatacacatacaaccacattaaactgaattaacttttgtacagcttaggttgtcaaggatttaataagaatgttaaaattatatgctgacataaaaatgaatattttaaatttagtaacccattttaatttaataaaatatgattttaaatgatttcacagaaatacttcatgcttgctccaaaaattaaaattctaaacaaacagaagaaaatttccagccaagaaatattttataaataattactttttaatttatggaggagggatggtttcccacatgcatcagaaataaatgcgaagtagtcggcaagaatatatgttttaggcttcagtaaagttgtacaatcactcaaatcatagcaacagtatttcatttccaatactataaagaaccagaagtagatcattttcataaacacatacttaatgcataattttggagtgtgtcaacaacactagagccttaagaatttctctctagaaaaaagtaactgtagttggattttaaatacaaataaagaacaaaaattttacttggctgggtgcagtggctcacgcctgtaatcccagcactttgggagacggaggtgggcagatcacttgagatcaggagttcaagaccagcctggccaacatggcaaaaccgcatctctactaaaaatatgaaaaattagctgggcgcggtggcgcacgcctgtaatcccagctactcaggaggctgagacaggagaatcgcttgaacccgggagacagaaattgcagtgagctgagttcacaccacttcactccagcctgggtgacacagtgagactcagtctcaaaaaaaccaaaaaaaattaacttagagttctgttagagatgttttgtttcactatttaaaaaattctatcaagggcaaaatctcctatttcagaggaaagcagttataagctgtatttagacatcaaatttgaatgacataaattactctgaatcacagaaagatgtagtctctaatttcaagaatcaaagtatgaataagaccagccatgaactaaatgtcacattctacacatgataaagtttgaacccctgatttctaaaacacatctggtctttcctttatctaaactcttgaaagcaaaagaacaagaactgagagtaaagagggcacttaccacctgatatggtttggctatgtccccacccaaatctcaccttgaattgtaactcccacaatttccatgtgttgtggaaggaacccagcaggaggtgactgaattatgggggtgggtctttcctgcaccattctcgtgatagtgactgagtctcacaagatctgatggtttttaaaatgggagtttccttgcacaagctccctctttgcctgccgccatccatgtaagatatgacttgctcctccttgccttccgccatgattgtgaggcctccccagccatgtgaaactgtaagtccattaaacttctttctggtataaattacccagtctcaggtatgtctttatcagcagtgtgaaatggactaatacactaccagacaaggacaatgcaacctttaataagtcagttagcaaacacatctttggggaaaataaaatttgtaaggctcaagaaacagaagacagaagcaaaatgaataaacagaagaggtaagagcagggaaagcaaaatcatgtaaatctgactctgacacagctctttaaattataagtgcattaaagaaaataatatgagaatgttccttattaaaaggaaaacctactgaagtatgctgacaacagaatgaaaaataaataggaaagaagtgcattacatatgtgtacttatcatgaagaacagaaaacaatttttctatcttctcctctcctgaattatttctaaaaagtaacaaaatacaaaacactcttgtatctcatagagatcattctcttattttatttgttgttgttgtttttgagacagggtctcactctgttgcccaggctgtagggcagtggatcaatctcagctcactgcaacctccacctcctgggcttaagcgatcctcccacatcagcctcccaagtagctgggaccagaggtgcacaccaccacatctggctgattttttaattttttatagagacagggtctcactatgttgcccaggctcatctcaaacccctgggctcaagcagtcctccgaaatcaatctcccaaagtgctgggattacaggcgtgagccaccacgcctggctgggactattttctaataacaacatacatgttcaaaaatgacacacattaaaaatcttaagtatttaaacctgaaatatctgcagagaataaataataaaatataaaaatataaacaaacttgtttcatctgatatttttctatagcaattatgatagttcaaataatgagagcaaatataattatcaaagacttctaaatattttaaaaacattaagatattactatatctatttttcagtgaaatatttattgagagcctaacacatgccaggtatttcactataaagactaaagatgtagatggcaaataagcaaaacatgatccgtgcccttataaaggttactttttagtgggaaagtgaaacatacattaggtagagatgtgtggtaaatgtcactcagaaaaattattcaattttatattttctggaaatactaatagaagttttgggaaaattcacaaataaaatgtatgagactggtgtttctcttacatgcagtttaaaaaaaaaaaaaaaactaatgagtcaatgtctttaaaggttagagttccttaagattttctatttgcttttacatttctccagaaaatttgtaattctttgttcaaaattttcataattttagaataaacttgttcaaagctgctattataattttaaaaatctcaacaggtaccctttacattcctaatattgttagtgtgtatttctcttatttattgatcaatgttaggaagattgcacaatttcaaacactggctccaccatttactacttgtgtggctttaggtaggttacttctctgggcctcagtttcctcaattttaaaaaaggaataaaaacagtactttctcccaaagcattactgaaggaattaaattagataatgcatgtatttagaacatgcctgagatataacataataagtgctcaataaatgtgatgtattatttttaagtgtagatttatttgtatatactttatttggaactcagcatccatcttcaatctgagatctcatgtttttctttaattttggaaaatatatgctttatctttctttcagatggcatttcttattctttttattctctggttctaaaactcctattaggcataagttgaagcttctcattctgtcttccatgttcttaacatttctcttcctttcctctttctttatatctacatgctgttttctaggtgacatcctcaaatcttccttcatattatgtaagtctgcctttgcatgattataaaatactatagtaagaactacacagtggcacatagaactcaaaagtttgctgaatgaaaaccgatgacattttaatatcaattattgtatgctttcatttctaagtattgtctgaccgctttcaaatcttcctgttccttttgtattgcacaggttttccattatgatcccattgtcctttttgtctataatcatttcaaacaaatttgtttcacagtctctttgaagtttttctattatcttcagttcttgttgtgtttattatcttacttatgtttgcacattcttctacatgatggtttgttttctcctgtggtttataatgcctgtaaccatcagcaaaggtcagtttatcctgtgggagcctggtgtgcctggagctatggaaacccatctacagggcagttgcatttggacatttgcttcagccaggctccaggagctctcattagttccaaccagggatatgggaaagaggttcatatgcaactcaagtttgtaggaattgtttatttatgcataattttttgcttattttacagtattttttattttgataggaatgactacatcattgttaatgaaattcctggcctcggtgaacaaattaacattcctttagatgtttttctctgaacaatatattcaagtcataccagatatgtatactactatcccaagtactggcagttctaaccttttctataaatcacctttttaataaaggaatgcaatacattgctgtgtatttttagagtaattgtcataaaaataatattaaatacattcaagttgtatgctaagagtttacataatcctttaagtaaattcaaaaaatggtgtcttccatgtattccttgcaaccaccctgggaagaaagggcatggtttactaatcccatttgagacatgaagatctgagatccaaacctactggctcatgtgcacacacagaaatatactacattcccatttactgttcatttggagtacacatatttgatattctcacattggtaactattcttccttgttttctgctaaattctagatactaaatcctgcaactcttcccacctattttacttcttcaattattaacatataacactaattggcactcctaatctacgagacacataatgctataggcattatgaaaacactatataacctcaaacctaaaatatatctttcacactttaatgtttctacaatcaggatgtatctttcaattaatgtcaaaggaaactttctgatgatcaggtagaaaagtaagttataatactactacaaacacaattgtacatataaaatatttgtttatctgggccaggtgcggtggctcatgcctgtaatcctagcactttgggaggccgaggcaggcagatcacgaggtcaggagattgagaccatcctggctaacacggtgaaaccccatctctactaaaaaaatacaaaaaaattagccaggcgtggtgatgggcgcctgtagtcccagctactcgggaggctgaggcaggagaatggtgtgaacctgggaggcggagcttgccgtgagccgagatcacgccactgcactccagcctgggcgacagagcgagactccctctcaaaaagaaaaaaaggaaaaaaaatatttgtttatctgaatattactttggttgaggtatttgcatttgtatgtcattgtgactgaattttaattcatttaattcctggttgtctagttttctaaaaagattatactgtgatactgttctgaaacagaaagtaagacgatacatataaagttgactgtcatataccaggtaaggcatttaattaaatacagtggaaaacatgaaatctttaagaactggttgctgaattacaatgccaggagaggatttatgcatcagaaaaaactcaagatactctcttctaaatttttcaaaaataattgatatattatttttctaaaacattgcttttgtcatattatttccctgttcaagaatctataatggtttcccactgcttcctaattcaaatataaactcctacacaacttgcaaggccctctattacctggcttcattagtttatacaattttaattgtcttttttttttcctccacaattctccatgagctctctgctttagtcagatcagtctctttaagtaagtctccatcttgcttacaactctgccttggtcctcacttcctgtgtcaccctcttactagcaggaaaaaccctgcctagccttcaggcccattcaagtcttaatctacgtcattttgagctcctatttatagctagagacattgttatgtaagttacccatggcatttgtctattcttggtttcaaaactattactttttccaaatttatgttgaatatggaaaacattattgatcatttctctttttcattagaggaaattctattaaaaagaaaagagattgtaaagatagaaaactaaatctcagagtaattaagtgaagtgcccagatcaaagagataaatatttcaagctagtcaaaaaaccaggttagtgatcttttactttcatagtactgatacatgaagtaaggagcaaaacaaaagatatgtatcaggccgggcgtggtggctcacgcctgtaatcccagcacttcaggaggctgaggcaggtgaatcacttgaggttaggagttcgagaccagcctggccaacatggagaaaccccgtgtctactaaaaatacaaaaattagccaggtgtggtagtgcacacctgcaatcccagctactcgggaggctgaggcaggagaactgcttgaacccaggaggtgggggttgcagtgagtcaagatggcaccattgcactccagcctgggcgacagagtgagaatccaactcaaaaaaaaaaaaaaaaaaaaagatatgtatcaaatcctgtgtcctattttgcttttcagctagcttaatataaaaattaaaatcacaaatgggacccattacacatttctgtttattgcatgttgatccactgacattcctctttcctgatcagactgaaagtttatgaactttcaagtgtaagttcacataaatacaaattaggtgtgattattgggagcaggggagatggggaggattaattatggatttgcttagagacacaaagatatatttgaacttgggaaagcagccttaagagtctctcttgggtgctatttccatgttgttgggttttttttttttctggttatacttatgcaatatgactccatttgggatttcaagtaaagctggaatgctgtattctctaaggaattaatactgttcagtttttttgttaaaacaaagaatgtgatacttttggtcaaaagttctttctctggaattcatgataaatgaaaagaatcttggcagtttctatgtcattctgcatctcacaagcaacgtgcaattcttcatgtcactacaacttggttattcactgaaacaactgatcttattacaaaacaagttaaagaaacaaacaaagcctccttcagttcctgccttgattcattattagaattcacctttcctttcacctcacccacaatcccagatatttgaaggccaaatgttgttctctctgaaagacaggacattagacaatttaaacatcagcaaattgagttcagctatccttagtcactgactgatgactctattcctatttgtacatttttaaagtaatacttatgtccttcctggaagttctttttgcattccagattacgacagggactaaagtacaacaaagaaaaaacgcaaaaagtcaagtgtcaggcagaataagatccataagcatacatatatgtaagtctgggtcaaattcaccagggtattaatctttattttaaaattacaagtaatatttatcaaattttgcccaaagtaatttaattctggcttagtatcaaattttaaaatatggtcagaggtatacatttcaaacatatgtaagcagaaaatatttacaaagaatttaaattctataataaataatatttggttgtaccatatatcctctttctaatgtcatgtgataatcagatgtaaaaattgctaccatccattttccatctccaattttagaagatgtaatgtacctgttccccccaaaatcagagatgacataattgaatgagttaaaatttctaaaatttccctagaggaatttcaaagaaaataagcaatttagtaagaacattagaaaatctcaaacatttttaaatggtatacaccctctatctctaaattacctaaggttcatttagcaaataactattgtctttattctgctgatcacctgaagtactggaagaaaaaaaaaaaacaaaactaaacaaacaaacaaacaaaaaaaaaacactcagcatcttcctctgttaaagtcacatctgcaggaaaaaggctactaaaaaaagaacaatctgctgttccaagttcatatcctgccagtagatattttgcaattctcagggtagaacaatgtttgaaaaaaacagttttataggatcaaatatttaaggtggaaattccatactcagaatatttaaatggtagttacattactaattaatatattttactaagtctgccactttgtccaagtctccagtttgtaccatgttttctaaaactttatatgacaaagcttgtcttagtacttcctgttccgcttgtttttcccatggactatatttaccatttatgattctcatgagtaaatactagtataaagaataaagtagagacaatttttctgaaaaaatccagaaaagaattaaagagatatacagataaaaacaataaaggcataagcaacaaacactattccagttgaactgtacttaatctcccaaagcaaaagtttaagttaaataaatgttcatttaactgttcttaggccactgcaaggtcaaaaatagattcaaaagttcttaaccaagtgatatgctgttatcttgtatacactggtcaaagtcattgataagagaacctgacatgtctgttttcacattatttcttcatttattaaagtgattctctgttttaaactctgatggctaaattaataaataattgcttagtaaattggagtccgacagtatgtgaaccaaagaatgtttaatctcctgggataaaattatttatagggtcataaaaaaaccacctacctaatatcttgtggttacaattacttatgtttttatgtttatttcagtgtttctcaactctgtgctgtggaatcaacctgggaggctttttaaattttgcaatatcaagactccatctcaaattgtataaatcagaatatcttggcagtcgggccttagaatcaatattttaaattttctaattatggtaaaaacataaaatttatcatctcatccattggtaaatgtatagttcagtagtgttaactatgtgtacactgttgtgcaacagatctctagaactttttcatcctgcaaaactgaaactctatacccactgaacaactccccattttcccttcccctagcccctggcaatcccattctacttcctgattctatgagtttgactactttagagacctgttataaatgaaattattaagtatgtgtcttctcatgactggcttgtttcacacagcataatgttctcatggtttatccatgttatagcatgtaataggattttcttcttttttaaggctggataatattctattgaatgtatataccacattttctttattctactgacagacatctgggttgcttctacttcttggctgcagtaaataatgctgcaatgaatatgggtgtgcaaatatctttgcaattctccttgaagttcttctggaagtacacccaaaagtggaattgttgaatcattcagtaaatataatttttttaatttttagttttaattttttaaggacccttcatactgtttcccacaatggctgtaccatgttacattcctgctaatagggcaaaagggtctaatttaatccacatcctcagtaacacttgttgttttctgtttgttttttcttctgttttttttgagacagagtctcgctctgtcacccaggctggagtgcagtggcgtgatctcagctcactgcaacctccgcctccgggttcaagcgattctcctgcttcagcctcctgagtagctgggattacaggcgtgtgccaccacgcccagctaatttttgtatttttagtagagatggggtttcaccatgttgattaggctggtctcgaactcctgaccttgtgatccacctgcctcggcctcccaaagtgctgggagctagcaggcgtgagctaccgtgcccagccatgcccggctaattttttatatttttggtagagacgaggttccaccacgttggcaaggctggtctcgaactcctgtcctcaagttatctacctgcctcggcctcccaaagtgctgggattacaggcttgagccatcacgccccgcctgttttttgtttgtttgtttgtttaatagtatccaacctaatgggtgcggtgtgacatctcattgtggttttaatttgcatttctctaatgattagtgatgttaagaaacatccacataataacatccagtcagaaatacgggatcagcactcagaagataatgcatagataggtaatggttgaaatacaattagatgagagacaaaactttcaagtaagactggtttgcttcttccatctaagacagcctgcttctgtctttgaaatctctccaatctctcctttttctatattctttcaatccaattctgctcttaagaaaggatttaatatgacttgaggaacattttttatttctcccagggacatttatgtatgaagtcttaacactgttaaaggaaagatatatccccctcccaccaccacatggtaaggaggatgggataaagccttaagacttagctacaaggcagaggtatgcagggctagtattctcgaaaccaattttacatatgactagcagctgatcccctatttcacctaagactgacaatttttagaaacaaaaacaaccaacattgatataaaaatatgcttttgtacaagccaagcatttacttgggaacctgtagaataaattacagttgtcctcttttacccacagtttcattttctgtgccttcagatctgaaaatattaaacagaaaattctagaaataaataattcataagttttaaatttcataccattctgcatagtgtgatgaaatctgtcaccactccatccagcctcggacagaaatcactcctttgtccagtgaatccacaatgtgtatgctatctgcccacctgttactcacttagtaccatcctggttatgatgactgctgaagtattacagggtttgtgttcaagtaacccttattttacttagtaatgtccccaaagtacaagagtagtgatgctggcaattcagatatgccaaagagaagccataaagtgcttcctttaagtgtaaaagtgaaaattctcaagtgaataaggaaagaaaaaaatcatatgcttaggctgctatgatctatggtaggaataaatcttctacccatgacattgtgaagaaggaaaaagaaattcatgctaatgttgctgtcacacctcaaactgccaaagttacagctacagtgtatatagtaagtgtttagttaagatgaaaaaggcattaaatttgtgggtggaagacaggaataaaaatgtattccaactgatggcaatcaagtgggtactgtccacagtttcagggtgggagtcttcgaacatatactcctcagctaagtggggactaatatatatttatgtattttagagtgcacagctagaactcagaacaggccctaaaaacttgcttaatatttgaattatgagacttttccaacatctcacttgttcaacaccctcaattatgtggcacacagccaaggtcctaaaagtaggccaaacaagcaaactataaaaaactaaaattagatatcacaaatctttattaaaaggcacttgattttcctcataggagaatcatttgacactcactcagttattagatactattagtttacacataattctagcaaattcaactagtcattttccaatttataacaaatgcatttacactgggggtgaagatggagacacgggagtctcagcacgcacagtaggctaggtcagcccttcatacctgcacacttacacattacttgtatgcatcatttactagagtagattacaagaattgaaactctatagaatagccttagtcatcaaaggttaaattatattagtatgtgctctcagaaatatgcatagcttgtacagcatgtagttacacacacacatacacacccataccttgtctccgtttttcttctgctttctgccaaaagctattcaaacctcaaccatttcatgagtcaccacacaggcagctcttactttggctttacctctccctgcttggtttcaccactccaatcacctggctcaactatagaaaacccttctgattttccctactgaaggaaacatcagggttagagtgtcacaaaacactacaaaaccgaaatgaatccatgtatgctcatctttgaaagagaaagtcagggaggaagagttcgacaaacagaaacaggaataagaagggaaacatagggttcagctcacaaatacttgcaatttatttgagtacaaaatattcattcctctaagtagtttatttatgacagacactttgaggtactgtatactctaatcacttgttctactttatctgtctttaacattactaggaaaaactgaaggatttccctgttatctgggtagttttataaatcccgacaataaaaaatctaccaagagaatgtgatatttaagtttttgtattcatatttttaaaattctttttaaaaatacaaaaattaaaatcacttatccctacttgaaaaaagagagagaaatctacttcctaacagtgcctaatggttatagatctccactagttcctgttgtattcagagtcgagtttaatctctctcccctagtcttgactataaagtcttccttacaaaaaaaaaaagaaaaatattttccttacttccactaacataaataagctttattgtctgcattattcagacctaggtataaacatacacatgtaataatagctttttaaaataaaaatgtacatttgtccacatcttgcttttctcacttaacaatgtcattcttttctacacttctcaaacatggtgtatttacctaacaacaagactactgagacggttttcagtattttgctattccaagaaacaccaatgaatatgcttataacaaattagaatctcactattaaagtgtgaatatgaacagcctaacactaatagttagttatagaaacattttatggtttggccaacctgatagccaaaatcttcattcacttttattttagattgcctttaaaaaattatgactgagattgcaggcagcttctcatggtttctggcaatatgtgtttcttcagtgaactgacagtttgtatttttttggttgttgtttagttttactattaagttctaaggtgtttttgatcaaggtaatcaacctttgtatcttttaacttggttgacagtatctaccacagtacactaacattaagaaaatttatccttccaatggcatactagaaaactgttaacctgcctacttactctatctgattagagtctagacactgtgaagttccatgtaacttgtacatttccgtcctagagaaagcagaaacccaaaggttaccgttttataactttttagaaaattaaccaaatttgtatctaatcaatattattctgaaggcatcatttttcaattttcctggaaaggtgaactatataagtccctattattcaaatgctctaatatcaagttttattatcttactggttcctactttaattaaaatgttgaatgagtttttgacacatgttcattctgtattttcatgagagtcatttttctaatgtgtgaaaatttcctgacatttaatttatttgtagatagagctatcacaatgttattcctttaaagcacctgggctttctcattaactgaggaaggtcatctccatctctgcactgtgaaaaaataaaaacaaaaaaatatatatactcatctattttccacagattaaaaaaattttctggctgggcgtggtggttcacgcctgtaatctcagcactttgggaggccgaggcaggcggatcacctgaggtcaggagttggagaccagcctgaccaacatggcaaaaccccgtctctactaaaagtacaaaaattagccgggcgtggtggcaggtgcctgtaatcccagctactcaggaggctgaggcaggaggagaattgcttgaacccgggaggcggaggttgcagtgagccgagatctcgctactgcactccagcctgggtgacaagagagagactgtgtctcaaaaaaaaaaaaaaaaaaattctacttagaattttaccatgaatagtatgattatgcagttttactctttcaatatgtaatgaattatattgatatatttcattataatgaaacatactgtacatctcaaatgaaaactacatagcatattactctctcaacagactacgagattcgattttctaatactttgcttaggatttttgcaaccatattttcccttttttgctatcttcattaagttttttttgtactgaagtaatgccaccttcatataatacagtgagatgctttctatatttttaatatttggaaatagttttaatagtaatttaagaattttcagttacttgttaatgaacgacactagaaagggcagtaagtctataaaactacatagcctcctgccttttatatgtgtgtctgtctgtcatatctttaacaactctagatttaaagaaaattgtaaatatagaatacagtccttatatacccttcactcagcatcctcctatgttaacatcttagagacagggtacagttgtttgaactaagaagttagcattagtataatactatcaactaagctacagactctatccagatttccccagtgtttccactaatgtccttttctgttccaggacactatactgcatttagcatcatgactctttaattgtcctcctctgctctgtgataatttctcagtcttttctttttttcccataaacttggcaattttaaaaagtatgagtcagaaattttgtagaatgttccaaaatttgggtttattttctgtgttctcatgcctagactgtgttacggatttaggggaaggataccacaaaggtgaagtgatcttctcattgcatcatattgggaggtacattctatccacatgacttattactggtgatgtgaatcttggttacttagtttttaacagtccttttcacttcatccatcgttatcagtttgttcaggttttctctctcaagtttcattctgatactttatattttattttaaaatgtaattgtctcatctagatttaataactgtgtatgtttaaaactgcacaaaatgttttatcatttttggtactatctaaatctgtggttatactgcttttctcaaccctaatactgtatattattgttttctttctcttttttcttaggcttctttagggtatacctaatttgttcatttttggagtttcattatcaattatattttggttttctaatttactgtcaccgttgaactctattatgtatcaaaggaatggtatttagatcttgataaatggtcaatgtgttgacagatcaagaaggaaagaggaaggcaaagggaacaagccagatgactacagcaatagaaggctggaaaatatggagcatgtgatctgtaatctggtctagctataatatataatacatgcaggaatgaaaaagaatagatgtaagcaagcaacattaaacaggtgggaataaaatattatatttagtaaataaatactgaaaaattaaacacaaaatttcatacaatccaacaattttacttctgggtatatatccaaaagaactgacaccagaaattcaaacagatatttgtctatccatgcttatggcagtactagtcacaatagccaaaaagtgaaagtaatccaactgtccatcaatggatgaataggttaaacaaaatgtactataatcatacatcaggatattattcatgtttaaaaaggaaagaaattctgatacttgctataccatggatgacccttgaagtcattacactaagtgaaataagtaagacacaagagatcaaataattgcatgattctacttataaagggtacctaaaataggcaaatcatagagacatacaagggaacagagattaccaggaggtaggggcaaagggaaattgagagttttttaaaaaatgaatacagtgtttcagtttcggatgatggaaaagttctggagatgaatagcaacaacagttgcacaacaatgtgaatgtacttaatgcctctgaatggtacacttacaacacttaaaatggtacattttatgtgtatgcatattttatcataatttaaaaaattaaataaatacagattccttactacctggaattaaagattctacataattagtttgaaatgtttttcacatattatgctttactatttactgacaaagtgtctggctctctcaaaagaaagtttaaagaatgaatgggcaaaactgtttcctcttttaggctggtcttaacctcacaatattctaaaagagtcatgctaattcctccaatgcatccttttctattgttgttatctcatcaacatccctccattgcctccacagtccacctccccatctatatctttatcttaaccatcttctaagggtcagttctccatggagtctttcccaataattctacttgatggttctctatctctattttctatccaaaaatccttttgtgtcaaagtatgtcatttgactacactttttagaattttatctattaacatcacctaacagttaaatatattgtctttatctactggaataagaccgaaagcaccttaagagatagggattttggtcatgcttcttttatatccctatatggcctaacacagtgctaaataatacagaacagaatacacaagtggttaagagctcaagatctgctgttactaactcaatataaaaaccacttctaccactaagtaggctacgcaaattatgaggctaagcaagtaacgaggttaggcaagttacttaatctgagtctcttctttctcacttgcaaaatggcaagaataaaagtatctatactttataacattatgtgagcattaaataaaataatgaatgttaaaagaacataagcactcaataaaggttagcattcagtattactattagaagtgtctgatactatttagcctaaatgatgttgagcaaatttctgagaagttgaattataaatgaaactcgattttggtgactctacagcgcactggtgacaaacttgagaaaataatacgattaaacacacacttgtttgtttgccagttctttagctgtcttcctaactacactaccttcacgaagtcaggcattgtatcagttttacctactaccatatagagagcacctaaacacagaagttgggagaagtatactgcgcacaaatttggcattcaaataactactgaataaattaatcaaaaagctaatattttgtaaaattcaaactcagatgcttacattactaacaataacacctcttcctcttttccctgtaagaaaagatgattctgcctccttgaacagtaaaagcagagattatattttttacaaaggtaaccacagaatatcaatctgtttcagtccctgcctattttacaacatgctctaatcccaagaacatatgctagataaagaaaaataatctgtagttgtacattacacactggttaaaaactctgatgactctggcaatagatgaaactacagtactaaacctcaaggtcctaaagaaaatactgctgttcagactgaaaatgagaaacagtatactttggcagttttattaatttataaactcaacttgtagaaaaaagaatgctcaacaaaataaaagttgtgaatttagaaagttgcaaacatttcatctgtttaaaacacgtaggggaaataagtttgttttctttcaaaccacatttgctaataaatacatgtttattttcccgcttcttttcttacctagttctattcagctatcaaaacaggaattcctttccacctgcaccaacgtagatagtatccaaacaattagactacaggctaaaagagtcatgtttcccatgaaatactatttcttactcctttgttaccattttcttggtgataagaagcattgagaaaaatggttttgttatttgcacgcaattttctctctttttttttttttttttttttttttgagacacagtctcgctccatcaggctggagtgcagtggcacgatcttggcttactgcaacctcgacctccccagttcaagcgattctcctgcctcaacctcctgagtagctgggattacaggcatgcaccaccacacccagttaatttttgtatttttagcagagtcggggtttcgtcctgttggccaggctggtctcgaactcctgacctcaagtgatctgctgccttggcctcccagactgctgggattacaggcatgagccaccgcgcccggccaattttctctcctttcttcaaaggaatcaacagctatatatcaaacacatagccatgtgctgtgcttaggaagtgagaaaactaaaaaataaattataagtaaggcaggtgctctcttatatcagctcacacctaattagatcctcctttaattttgttgaaagcaattaattgggaatcatctaacttctaatagggtttgtacacagacatgagaattattcagtttctaatcttctgggaagtaaaccaaaatagtttttccaaaaattatcttgtgaatattaattatgtctctaaattttttacctacggacagcgtctttaatcaaataaaaaggcagtaatcgtagcagtttgggaggccaaaacaggagggttgcttgaggccacgagttcaagaccagccagggcaacatagcgagacccccatctctaaacaaacaaacaaacaaacattaatgaggtatggtggtgcatacctgtaattccagctacttgggaagctgaggtgggaatctcatttgaacccaggaggtcaagactgcagtgagccaagatcatgccactgcactccagcctgggtgaaagaaggagaccccaatctcaaaatattaaaaaagaaaaaaccaaaaagggactggaaaacttaaaatagtcttaaatttcaatacacctcgccaggcgcagtggctcatgcctgtaataccagcactttgggaggccgaggtgggcagatcacgaggtcaggagattgaaaccatcctggctaacacagtgaaaccccatctctactaaaaatacaaacaattagccgggtgtggtggcgggcacctgtagtcccagctacttgggaggctgagacaggagaatcactttaacgcaggaggcggaggttgcagtgagccgagatcgcaccactgtactccagcctgggtgacagagcaagacaccatctcagaaaaaaaaaaaaaattcagtagatttcttaacactcttaacaatatacccttaaacaatttttttagtttttattttaaaattatagaaattcatcaagttacaaggcaatacaatgaggtcccctgtactctttactcagttccccccatggttatttcttatataatacaatatcaaaaccagaaaaatcacattgatacaatgtgtgtatagttctatgtcattttatcacatgcatagatctgtgtaatcaccatcacaatcaataaataaaactattctcactataaagagcttcctcatgctacacttttatagtttcacccaaccccgcccccacaaaaatcccatgactaccattaatttcctggtgacctctacaattgtgttgtttggagaatgctatataaattgaatcgtacagtatgtgtctttttgagactgatttttttcacttacataatgctcctgactgagatctgtccaaatttttgagggtatcaatagttcattactttatattgctacgagatataccatagtatagatgtaccacagtttaatcactcctactattgtaggacattttggttgtttccaattttgggccattgaaaataaaaccatgtatgggattctgtgcagaaataaattttaatttatctaggagaaacgcccaagagtacaactgctgagtcatatggttaagtgtatagttagcattttaagaaattgctaaaccgttttccagagcaactatactattttacaactcctaccagcaatgtgtgagagactgtattaccatatccttgccacctccagtggctgttccttgcccacatttaatattgccactaattttttttttttttttaaagatagggtctggctctgttgcccaggctggagtacagtggcacgatcacggctcactgcagccttgacctcccaggcttaagtagatcctcctaccctaaatcctttttggcaaaatatctttttgtgtcttttgcacattttctaaatgaactgttgtttactgttgtttttaaaaaagattgtgatttgagagttctttatatattctcttgttttgctcttgttgcccaggctggagtgcaatgctgtgaccttggctcactgcaacctccgcctcccaggttcaagcgattctcctgcctcagcctcccaagtagctgggactacaggtatgcaccaccacatctggctaatttttgtatttttagtagagacaggatttctccatgttggtcaggctggaggctggtctcaaactcctgacctcaagtgatctgcccacctcggcctcccaaagtgctgggattacaggcatgagccaccacgcccggccaagagagttctttatctattctatatacaagtcttttgtcaggtggtggtttgccaatattttatcctagtcttttcattctcattacagggtatttagcacagcaaaagttcttaattttaatacattccaatttagcaattttttatagatcatgtttcttgtgtcatgtctaagaactcttcaccaagttttagttccaaagatgttctatgttttctcctaaaagttttatagttttacattttaaacttcagtctattatccattttgagttactctggtaccactgtgagtcttaggtcaagattatttttttggtctaagttttttgtctatggatatccaattgcactggccccacttctgaagaatactattcttttcctttgaattgtttttgtacctttgtcaaaagccaggtggctgtaattggataggctatttctgggtttgctgttctgttccactgacctagtggtcaatggaacaaaccaaatatatatatttggtttctgcccctggttctaacacaaagctcctaaaactcttgtaatttcgtgaacgacaggggtcctaatgtgtccagaattggtgggttcttggtctcactgacttcaagaatgaagccgtggaccctcgcggtgagtgttacagctcttaaggtggcgtgtctggagtctgtcccttctgatgttcagatgtgtttggagtttcttccttctggtgggtttgtggtctcgctggctcaggagtgaagctgcagaccttcgcggtgagtgttacagctcttaaggcagcgcgtctggagttgttcgttcctcccggtgggctcgtggtctcgctgggctcaggagtgaagctgcagatcttcacggtgagtgttacagctcataaaagcagtgtggacccaaagagtgagcagtagcaagatttattgcaaagaacgaaagaacaaagcttccacagtgtggaaggggacccgagcgggttgccaatgctggctcgggcagcctgcttttgttctgttatctggccccacccacatcctgctgattggtagggccgagtggcctgttttgtcagggcgctgattggtgcgtttacaatccctgagctagatacaaaggttctccacgtccccatcagattagttagatacaaagtttccacacacaggttctccaaggccccaccagagaagctaggtacagagtgtcgattggtgcattcacaaaccttgagctaaacacagggtgctgattggtgtgtttacaaaccttgagctagatacagagtgccgattggtgtatttacaatccttgagctagacataaaggttctccacttcctcaccagagcagctagatacagagtgtcgattggtgcactcacaaaccttgagctaaacacagggtgctgattggtgtatttacaatccctgagctagatataaagactctccacatccccatcagactcaggagcccagctggcttcacctagtggatcccgcgtaggggctgcaggtggagctgcctgccagtcctgcgccgtgtgctcgcattcctcagcccttgggtggtcgatgggactgggtgccgtggagcagggggtggtgcttgtcggggaggctcgggccgcacaggagcccatggagtgggtgggaggcttaggcatggcgggctgcaggtcccgagccctgccccgtgggagggcagccaaggcccagcgagaaatcgaacgcagtgccggtgggccagcactgctgggggactcagtacaccctccgcagccactggcctgggtgctaagtcccccattgcccagggccagcagggctgcctggctgctccgagtgcggggcccaccaagcccacgcccacccggaactccagctggcccgcaagtgccgcacacagccccggttcccgctcatgcctctccctccacacctccctgcaagctgagggagtgggctccggccttggccaggccagaaaggggctcccacagtgcaatgggggactgaagggctcctcaaatgccaccaaagtgggagcccaggcaggggaggtgccgagagcaagcgagggctctgaggactgccagcacgctgtcacctctcactaagagcatcttttgttctaatatttggtctttgaccttggttcctgacacagaactcctaaaaccactgagtgatagcaatgataggaacatcttacgtaaagcttctgaattccttagactttgtattagtccgattttatgctgctgataaagacatacctgagaccgggcaatttacaaagaaaggcgtttaatagactcacagttccatgtggctggggaggcctcacaatcatggcagaaggtgaaaggcatatctcacatggcggcagacaagagaagagaacatatatatacagggaaactcccctttacaaaaccatcagatctcatgagacttattcactatcactagaacagcacaggaaagacctgcccccctgattcaattacctcccactgggtccctcccatgacacatggcaattgtgggagctacaattcaagataaaattagggtggggacacagccaaaccatatcattctgccctggccccccccaaacctcatgtcctcacatttcaaaaccagtcatgccttcccaacagtcccccaaagtcttaactcatgtcagcattaacgtgaaagtccacagtccaaagtctcatcagagacaaggcaagtcctttctgcctatgagcctgtaaaatcaaaagcaagtttattacttcctagatacaatgggggtacaggcattgggtaaatacagccatttcaaatgtgagaaattgaccaaaacaaaggggttacaggcactgtgcaagtccgaaatccagcaggtcagtcaaatcttaaagctccaaaatgatctcctttgactccaggtctcatatccaggtcacacggatgcaagaggtaagctgtatggtcttgggcagctccgcccctgtggctttgcagggtatagcctccctcctggctgctttcacgggctgctgttgagtgtctgtggcttttccaggcacacagtgcaagctgtcggtggatctaccattctgggatctggaggacagtggccctcttctcacagctccactaggcagcagcccagtggggactctgtatgggggcttcaaccccacgtttcccttttgcactgccctagcagaagttcttcctgaggaccctgccccagcagcaaacttgttcctggacatccaggcatttccacacatcttctgaaacctaggtggaggttcccaaacctcagttcttgacttctgtgcactggcaggctcaacaccgcgttgaagttgccaaggcttagggcttgcagcctctgaagccacagcccacactgtaccttggcccctttcagtcactgctagagcagctaggaggcagggcaccaagtccctagactgcacacagcagtgggaccctgggcctggcccaggaaaccattttttcctcctaggcctctgggtctgtgatggcaggggctgccacagaggtctctgacacgccctagagaccttttccgcatggccttggcaattaacatttggctcctcgttacttatgcaaatttctgcagctggcttgaatttctccttagaaaatgggattttcctttctattgcattgtcaggctgcaaatcatctgaacgtttatgctctgcttccgttataaaattaaatgcctttaacagcacccaagtcacatcttgaatgctttgctgcttataaatttcttctcccacaccctaaatcaactctctcaagttcaaagttccacaaatctctagggcaggggcaatctgtcaccagtctctttgctaaaacataataagagtcacttttgctccagttcccaataagttcttcatttccatttgagaccacatcagcctgaactttattgtccatatcactatcagcattttggtcaaagccattcaacaagtctaggaggttccaaactgtcctacattttcctatcttctcctaagccttccaaactgttccaacctcggcctgctacccagttccaaagttgcttccacattttttgggtatctttactgcagcgccccactctcctggtaccaatttattgtattagtccatttttatgttgctttataagcaacataaagacatacctgatactgggcgatttacaaaagaaaggcgtttaatagactcacagctccacatggctggggaggcctcacaatcatggcagaaggtgaaaggcatgtctcacatggcagccaacaagagaagacaacttgtgcagggaaattcccctttataacaccatcagatctcatgagacttattcactatcacgagaatatcatgggaaagacctgcctccatgactcaattacctccacaaggtcccccccaacaacacatgggaattatgagaactacaattcaaggtgagatttggatagggacacagccaaaccatatcaggcttccttggtgacaagcgtatctttgctctaatgaagaaactcttggtgggctcctgaatagcttcaggatggggagctgatcaccagaaagaccaagccataatttgaagctggggacttttagccccatctgcattctccagggagtggctggagactgagttagtatttgattatgtgtacacactgaagcctccacaaaaagcctatctgctgaagcctccaaaactgcagggcttggagaacaaacaaattatcaaacctgaggaggatgttgtatggccaagtcagacaaaagcatgcatactccatacttgcaactagcacctgaaatgggaggtaaggtactcttgtgggactgagcctttaatccgtgggaattctaggtaattaatgtcaaaaactgagttaaactataggacactctattggtatccacagagaagtgaagaactgcttggtgtggaacacccatgcatttgatataagaagtgttgcgaataaagaaactgtttttcttttattatctttctgccaatacaataggatgattcttcccacttttttcttctttttctaaattgttttagctattctaattccttcaactttccatatatataatcttgtccatgtactagaaaaatctttggggatttttataagaattgtgttaaacctgtgtatcaacttgagtggaattagcatctttactgtattgagtcttccaatctatgtacacagtatttccatttacttagatctttaattttttccccaacattttgtagtctcagcatataagtcctgtatgtgttttgttggatttacacctaaatacatcatttcttttagtaactgtaaattacactgtattttaaaatttttccacatcttcattgacaggatatacaaaaatacaattagtttttgtacgatctcataacctgtgaatctatataactcacttattagttctagatgtgtttttgtgtactctttggaattgtctatacacataatgatgtcaactacaaacagggacagatttattccttccattttgatctgcatgtcctttatttccttgttttgtggtattgagctggctagaacttccaacagcatattgaatagcagtagtgagagcagacatcctttcttattctcaatcttagggggaaagcattcaatttttcaccagtaagtataatgttaccttcggctttctgtagctgttctttatcaagctgaagcagttcccctctattcctagctttctaagattttttaaaaattataaatgggtgttgaattttgtcaaatgctttttccacatttataaacattttgtagttttccttttttgtctttgtctgcttttggtatcagagtaacacaggctttaaaaaataaattgaggccgggcgcggtggttcacgtctgtaatcccagcactttgggaggccgaggtgggtggatcacctgtggtccagagttcaagaccagtctagtcaacatggtgaaaccccgtctctactaaaaatataaaaattagctgggtgtggttggcggacgcctgtaatctcgggaggctgaggcaggagaatcgcttgaacccaggaggcagaggttgcagtgagccgagattgtgccattgcactccagcctgggagacagagtaagactccatctccaaaaataaataaataaataaataaataaatttctatttttttggaaccaattgtatagaatgaatgttaatcagtctttaaacatttaatataattatctggtaaaatcatctaggtttggagatttctattttgagaattttaaaattatgaattcaattttcttaacagaattattcaaattatctattttatattgggtgagttgcagcaggttgtgcttttcaagtcatttgtccatttcatctaactgagtcaaatttacatgcatagagttatttgtagcagtttctcattaactcgttgatgactgactatagggtctctagtgatatttcatttcatttctgatattgaacattttgtctatttgttctaggggtgtaacaattgtatcatcccctcaaagagccaactgtgtgtttcattgatttttctctagttttcaatttcattgatttctgttttcatgtttattgcttccttcttactgcttggcttaactattctgagcttcttttcctatttttttttttttgagacaggattttagatgatcaattttagacttttcctcttctccagtataagcatgtagtactgtaagtttccatctgagtaatactttagctgaatctcagaattttgatatgttgtacttccattcaatgtatttttatttctttgaaccactatttagaaacatactgttcacttttcaagtgtccagagattttcctattttctttccattatggatatctagtttgattccatggtggtgagagaacatactctatatgtttcaaatttaaaaaaatttttcagatttcttagtggttcagactatggtctgtcttggtgtatttaccatgaacatttgaaaacactgtattctgctatttgtggatagaatgttccttgtctgcgttttccttggaaagtcttcatgcatcccaggataagactgctaatttgcccatcaactggactctttaacaaatgtgactatggaaaaccatgtaagaaactaactcatataataaaaaagtattaatggaaggggagattattcatatcataaactattactacagtaactccagaaaattacatatttaaatttcatttgggaaggagtgtgtattatttttagtttacatgagtattaaaaattacttatttttgggaaaatgttaagattttcatttatttagcccatcaaaaaatattttctaagcactctatcatatacaaaggattgtggttggtccagactctctaggggatcgtaaaccaggcatattgtagagtctccagcagttttttccttgtgttagatcaccgccatccaaaagcattttctgtaatgatggaactgttcttcatctgtgatgtcaaagactgtagtcactagatatatgaggctattgaacacttcaaattagcgtattagaagtgtagcaccagaacataatacaggccccttgcatttattacactttccttgttcaaagctgtgcaagatttgtctgaatttaaagcagataagacaggagtgactgagatacccagttttacattagactgcttcagattttacttttacattttctatcacatgggctaaaattgctcccgtatataagctcctgttcaatcttagctatttgctttatttaatttttgttcaataaaaaggatggtgttaagtaattgtcttcctgccttcattccaaaaatatgactaatcttggccaagtaagttattgtcctcattagtttccctgccaaggaaaaatcaacagaaaatgtcagccttctacatagctccttccatctacattcctgtgtggctactggctagatcattctgctcctacccactgggtgcggattagcagaagtataagtcaactatgatgcagatgctatccggagactcagaagggcaatccttaggtgtggtttccatgaataaaaggcctttggacatataaatataggagattaaacttgtatttcactttgatattgtgatttgtagtaagaaatatacatttggtctttgccaccagttcccggcacagtgcttctaaaacccttgtaatttcctgaatgacaggagtgccaggaccatcttttgttttaatatttggtctgtgactagaaacacagctcctaaaacctctggaatctcagaagtgtctttttttatgctaatgagatacatggtggctaaagtctcctgaagagcctccggttggggaatggcttccaggggaaccaacaatatgattagagcactggaagtttcagctctcctctcctgatgtcttacaaagagggactggcaattgagttaatcactattggccaatgattttaatcaatcatgcctacacaatgaggcctccacaaaaccccaaaggacgaggtttcaagagattctgggttggtgaacacatggaggttctgagaggtggtgtgcctaactggggcagggaagctctgtgtctctcccccttaagtgtcctatgtgtgtcttgcatttggttattcctgagttgtattctatataataaactgacactcataagtaaagtgttaccctcagttttgtcagctgttctagaaaattttcaagcccaaggaggggccatgagaacctcccatttatagctagtcagtcagaagcacaggtgacagtttggacttgagagtggcatttgaagtggggagcagtcttgtgggactgagtccttaacttgtggggtctgtagtaaccccaagtatataccatcagaattgcattgaactgtaatacacccagttggtgtcagaggttggaaattggttgatgtgggaaaaattcccacacatctgttttcagaagataaatattttaagtataggaaaacagtttatttttccttttttattcatataactttctttaaagacaagcaaatcatgattggaggtaaaatatgcccagaaaaaaagaaaaatggaagaaaaataaagacaggtaaatgaaaatgactcggtccagagatgcatatatccttactgtgtggcaaatataaaaatgcttgatctcctcttaccaaaaacacagacttaaatctatacctgtgaataaaagcatagaacccatgtaatagctacagtgtcatgttttgtattcagaaaaggtttataacagtgtttctcgggacccaggaaagaagagaaagctatgttattagaagtcactatgtacactattatctccagctgaatgtaaactgtgctcttgatgggaatagctaaagaaacatcaaatttaaagaaggagtcattagataatttttccatttcaaacagtgctttctgtgcttgctggttttgaccttcttctattccttcagaggccatctccccctctctctggaagagactgtaaataactaattattttagaacaagaaagaggcttgattcccttagctaatgtaatatgcatactagtctgtatgaacgctagaaatcatttctttcaaaagacattacaacttttattatccatcaaactaaatcatcaaaattatagcttccctcaagtttttaataaggtgatgctgcttgataaactaccacacatcttttgtcatcatataaatattttagtttcataactctctcataaatactagtaagtataggattggaaatcctttcagaaagcaaatcatagtgaagcatctatccagttctccaacaagactccccaactgatacattagttcaaaaataatcttaaaagcagtcaccatcaaacttattacaaaacttgcattcatcaagaaactatgccagaaaatttctgagtttaaatgtgttcaaatctgacttcgtagagcatttgatgtaacattcaggatagtaagaacagaagtaaaagctatccatcctctttaagctcttaaccttagagctctgcacctcttcttagaaacatcattcctccaatatttcagcctagatttttctcactgctaatactgcaattctgagaagaaggcaaattaactaaagttatcatcattagcagaggagtaacctgtgtcatagatatgaactgtaccacttctgaatgctttagacatttttcttagcaaagaagtatagatacggataaccagtactataacctgaaatactgcacaaaagcttataatttcttatcttgcatctgtcatttagaggtaaattaatttccttaattgctagagactaaggaatacatttttactctgtatttttcaatatttaagggaactatgttgttaggtcctcctgcaatgtgaaaggactgcaaggtctgactctcacaactaatttaaaaattgggatcattgtagaaagcctcttccatcaaagccacgggttgtaagaataaccttgcttttcaagattagttatactggggcaaaacattttttccttctctctactcaaattcctgaagtcccattatacttttctcaaagaagagtttataatacaaccagcgtgaagtcaccattctctatagaaatggcttctgatatatgaatttaacaaatgataggatataattctataaaacactgatacttagcacttccccacaaaccacataaaacttgtgaagtcaccattctctacagaaatgacttctgatatgtgaatatcataaatgataggctataattctataaaaccactgatacttagcacttccctacaaatcacataaactcgtagactgattttaaccaatacaactatttcacttctgtttgaggaagtattcaaactcagaatttattttgactgttttaagactttgtaacttgagatgtctccaaagagaatggtctaaagaaaggtaccacttggcaatgcaatgatagcatatgtaattgacacactcttagggaatcactctgcaaacccctgaacttataagggtataggtactattaagtagacatctctgctacaaagctaacaggtttgtgaaagtattcctcttcttaaattattgccaattctacccactttggttaatctataaaatattgatacggtgggcccccatccttactcctcccattaatttgacattgtaggctctagtcaattatgattttttttttttgagacagaattttgctcctgttgcccaggcgggagtgcaatggcgcaatctcggctcaccgtaacctctgcctcctgggttcaagcgattctcttacctcggcctcccaaatagctgggactacaggtgtgcgcccactacgcctggctaattttgtatttttagtagaaacggggtttcaccatgttggtcaggctggtctcgaactcctgacctcaggtgatccgcccacatgggcctcccatgaatttttacctataaaatgaaatcaaagaaaggtacagcagggagaaaccagctggctctgtgtgatataatcccatgagaaacaacatacaatgaaagaaaataacactaattactactatacctatactaaaacagtaaatgaagaaaaattctgggttcataaattggtagatcaatatcagtaagatgtcatgtctccctaaattgatctatagatttcagtgcaatcttcatcaaatttgtggcataagtttttttagatattaacaactgggtttttgcttttgttttttttttttagacgaagtctcgctctttcgcccaggccggactgcagtagcgctatcttggctcactgcaagctccgcctcccaggttcacgccattctcctgcctcagcctcccgagtagctgggactacaggcactcgctaccgcgcccggctaattttttttgtatttttagtagagacggggtttcaccgcattagccaggatggtctcgatctcctgacctcgtgatccgcccgtctcggcctcccaaagtgctgggattacaggcgtgagccactgtgcccggcccaacaactgagttttgacaaatgcatagagatatgtatccccactgaataatatttcctgatcttgatttaaccttcaagccttttctattgcatttacgctttgcatattcaataccattacttaatatatgcacgtagccaaaataatttttagcgccctatttagaaataaaaattacataataggtcaggtgtgatggctcatgcctataatcccagcactttgggaggcagaagtgggcagatggcttgagcccaggagtttgagaccagcctgggcaacatggtaaaacactgtctctacaaaaaaacacaaaaattagccaagctggtggtgtgcacctgtagtccccgctacctgggaggttaaggtgggaggactgcttgagcccgaaaggtggaggttacagtgagccaaggctgtgccactgcactccagcctgagtgacagagcaagaccctatctcaaaataaaataaaataaaataaacattaaggctggctttcttattagaaacaatttcatgaagaaaaaaataaatattttcactttacaagaactatgcttctggcagaatgtacatgtttgagaaatgtttgctgagtgaacatatgtaagtataaataaactttaaacacattctaggaagttgagatgatgtaaaagaaagcgagaaagttccatagtcattttctacatgttcttctatgctcaaaaaatctttatggtctcatggtacaagggaagaagtttagacctattaatgaaatattaggaaccataaacaattggcccctaatgcctttccagacttctcttctgttacaacctaacatccttccaaatccaaaataaatactaagcgtcaagcaacttaacatactacttcaggacttttgctgaagcagtgcaaatgccttttctctttagcatgtgttcaagctccacttacattccacttactgttgctacataataaattaatcccaaacatagcttaaattaaggatcaccttatcatggtcaaggagtatggggattaggaattcacgtagcacaaagaggcgatggcttgtctttgctttacaacgtccagggcctcagttaggacaacctggagactgaagatgatgcaacagtttgaggctggaatcatcttaagtcttgtccactcatacgcctggcacctgggctaggagattcaaaggctatgactgccaaacagagtaccaacccttggcctttccaaattgcttgatttcttcaaagaatgaagacctcagagtagtcagacttcttacattgcaggctcagggatctaagtgcaagtattccaagaaaaaggaatacatctggatcattatttatgacccagcctcagaagtgcatattcttttgttccaatcagttatgagaccacccagatttaaggaaagaagaaagaggtatacatcttgatgggaggggtataaaagagctttagggctgtgtttaaaaactaccacagcttttataatcatgacaaatttttacctccaagaaaatgtttacaaactcttcctaggcaaacttaaattctcccaaaatactcttagtattttatagttattatcatcacaggacttaatataaccttccatttaattgggagttcctcgagagatgggcttcataatttgtataccccattacagcacctggtatagtgctctatactaatgtcacaaatacattttttcaatatttattctatagtcaaactatccctgtttgcagatgacatgattctacacctaggaaatgtcacggtcttggcccaaaagttccttcagctgataaacaacttcagctaagtttcaggatacaatatcaacatacaaacaccactagcattcccatacaccaacaacagccaagctgaaagccaaatcaggaatgcagttccattcacaattgccaaaaaaagaaagagatacctaggaatacagctaaccaggaaggtgaaagaggtctacaatgagaattacaaaacactgctcaaagaaatcagagatgacacaaacaaatggaaaaaacattccatgcttatcagagaagtatcaatattgttaaaatggccatattgcccaaagaaatttatagatttaatgctattcctatcagactatcaatgacgttcttcaaaaactagaaaaaacattttaaaattcatatggaaccaaaaaagggccagaataaccaaggcaaatctaagcaaaaagaacaaggctagaagcatcatgttacccgatttcaaactatactacagggctacagtaaccaaaacagcacggggctgccacaaaatcagacacatagaccaatggaacagaataaagaacccagaagtaaggctgcataactacaatcatccaatcttgaacaaagccgacaaaaaacaagcactggggaaaggactccctatttaacaaatagtgctgcaataactggctagccgtatgcagaaaattgaaactggaccccttcgttacatcacatacaaaaattaactcaagatagaataaaaacttaaatgtaaaacccaaaacaataaaaaccctggaagacaacctaggcaataccattctaaatataggaactggcaaagagttcatgacaaagatgccaaaagcaattgcaacaaaagaaaaattgacaaatgggatctaattaaactaaagagcttctgcacagcaaaagaaactatcaacagagtaaacgacaacctacagaatgggagaaaatttttgcaagctatgtattgacaaaggtctaatattcagcaactctaaggaacttaaatttgcaagaaaaaataaccccattaaaaagtgggcaaaggacatgaacagacatttttcaaaagaagacatgcatgtggccaatgaccatatgaaaaaagctcaatttcactaatcattagggaaatgcaaaccaaaaccacaatgagataccatctcacaccagtcagaatggctattattaaaaagtaaaaaaaaaaaaaaaaatagatgctgacaaggttgtggagaaaagggaacacttatacactcttgggaggagtgtaaattagttcaaccattgtggaaagcagtgtggaaattcctcaaagagctaaaagcagaactatcatttgacccagcgatcccattagtgggtatatacccaaaggagtataactcgttctatcataaagacacatgcacccatatgtttactgcagtactattcacaatagcaaagagatgaagtcaacctaaatgtccatcaatggtagactggatacagaaaatgtggtacaaatacaccatggaatactatgcagccataaaaaagaatgagatcatgtcctgtgcaggaacatgaatggagctggaggccattatccttagcaaactaacagaaaaactgaaaaccaaatactgcatgttctcactttgagggagctaaacgatgagaacctatgggcaaaaagagggcaactacagacactgggacctacttaagggtggaggagggaagaagggagagaatcaggaaaaataactgctaggtactaggtttagtacctgggcaatgaaataatctgtacaaacaaacccccgtgacataaatttacctatataaaaaacctgcacatgaacccctgaactataacaaaagtttaaaatatatatatttattccacaactactacaaattctataatctactagtgataaataacagtgaataaggcagagtttgtgtctggttcttaaaacactattgtccatcagaatgaaattaagtaagtaattatggtaaaatacaaacccaataaatagcagctactagaaaaagttacttataaatgttctcagcttcagattcctaaatctctaaaacaggaataacattcacttctgataagtaactataaacagcaaataagatgacaatgtgctaaatgcttagcatggtacctaaaacactgtaaataatcaagaaatgttattttctaaaagttatcaaaatagtataaatgtaaaatattgatttttatatttgtgctttactatataatacgaagtttactgctataacccaaatctcaatgccttaacccaatgaaagtctaatattcattaaataataatttgggggtggcggtgagcaggagtatcgcagtagagagagaatacttggtacatggtcatttagggaactaagttccaaaaatcctgtgagatctacttttgaggacataattgaaagggaaaagaaagcaaaccctacatttgcctcgaaatgacttctgctcatattccattgacaaggcatagtcacatagcctccatacatgggggctatctgagtctatctgtatgccccaaaagagcaaagagagaatctaattagtttctggaacaatccattatttaactcactaaatacctattttttttttaattcttcctcccagatatagaatgcactcaagctctccactaggaagattaccaaaggtcccagccaggacaaaatctaggatctccagttcatacataatcttcttcatcagatgtagatgtcgctctccatgtccccacaacatacgccttaaagagaagatatctgtcctgtctccctctgtacaaaacacataccatggggaaacagagaaaggatcaccgcatttagaaatgcaaaaaaaaaaatggaaaatattcagtggttgctaatctgtagcattatgaaatcccactggatgtatgaacattgtgaaggaagaaattccttgttaaggccctaattttgttctccaggagaaactccctagtcctttgttgttctccatggctcctggcttcaccctctatgggttttccttgcctgttatctcccgtggccacatatgaagttggtgttgagaagtatgccacttgaggacagcttttagggctcaatgaacagtcacatgccttctaaggccaagttccaagtttctctagcaacaaaattccatcagaatcatagcagcttccagtcagatccaaatgctaataaccaactccaaaattactttttatcattctcaaatctgctttatttttttgcttcttttcccaatgtctcatctctctgttaatttactggtggctactctgacttttcaggctcaagaaagccacacatcttaatctgaccattatatcaatgtgtagccactcggctacacgtaagactgagaagtcttatggggtcttttttgctcaaagccttcttaaaatccatcttttatttttgagagtttaaaaacagtcattttttccaattctgaatttctggttattattttctttcactcctgtaaaccaaacaatagtttcctaaactcatctcttccttgactacatttggcaaggtaatgcaattacaatgaacacacactactaacaacttcttttcttaaaccttcaatcttggtagaaacatgaaatggcctccaagttgccaaaggtaagagttttacaaacattcatcacatgacatagatttctagccatcccaatatgctgtatgtgttcctcactgcccaacccttaggccaatgtcatatactttgggatcttgttacagtagcaacacaattcaaaatgtcaatttctatgttgatcagggtaagtaactctctctgctgtaacaactaactccaaagcttcagtggcttacacaacaaaagttttccctcttatgtcacaatcaatttgggacagggaaagatggtctttcactatgtgactcaatgacattttgtctactagtgtctatcctagggccttggaaactcccactaaatattcctcaatgaggagagtatggaaagttttgaaggaaattttagggttagttctaaacgtcatgctcattattttcatccacattctactctcgagagctagtatcatggccccacctaatacaagaggaagtacgtctaacagtatgccacagaagagagaaaatggttataatagaataaccacccagtctctgccatatctgtatccttgaacaaaaattgcatactcttatctatgccaaaatccaaaactatctatcatttcaagcagacccttctcagcccacagatggagaatactaaataaatgaagtccataggttcatttagttactctagtatataaagtataattctgatataaccatatgaacttaatccaaatcaaatatttcgttgtcattcttttaaagataaattatcttagtcatgattggataaaatttatgacagaaaactcattactttttcaggggcgaaacactattttcattcctgaccaaatgtcaacataaaagattaagatgaacaaatcaagatctattatttctggagaatgggattactgatggaagagggggtacttaaatggaaatataataatttaatatttaaatttactttgaaatgttttaaaatctatttcaaagaaaaaaattgttttgttacaataatctgtcttgtttaaataagtaacaatattttattgactagaaatcaaccccaaaagctagtttttaagctgtttagttgaaaactctttatcgacaaataactgatcatctgttttagttctaccttaacataaatgtcccacatattgtacctggataaaacagtaaagacttaaacacttcaaaggaaaacatactttaaatataaatggaggcatttagttatttttttttccctcaagtctatataaaaaggtcaactgctaagtaaaaacaagaataggaatgaaatgggaggataaatcttttaccaaataaggataaacgtagaactggagcaattatctaatatattaaattattaatcacatatgacttaaaccttctggaattggcatgaaatcattatagaaacaccagtcagcatttcttgtaagactcctaaaaaagtagaaggttcttcccaactttctatgctaaaggttgacatgtatttcccttggagaacatgtctatatgttatcaaatcttatattccaaaatacacagtctcttgccttcagggacgcaataacatttgaaaacatctatgcatacatacacaatactttatacctctaaaaatatccagtaatctagttctaaagaggttctataatgctaaccagaaaatcccttggcatctctttgctcgctcagccatctggatccatcttttttcgctgattagggaggaagagcacaaggttccatatatccattgatatctttaattaggattcctttcctccccatgttgttgaaagtcaaagaaacagcacacccaaaatatctttgaaaatggtaaaagtggtattcaaatgttactactgcatagagcttattttcttggttataataactcccattcacataattccttatagatcgcaaagtatacagcaggttaatctgattactccaactagttgacaaatgtaggaaatcagaaaaaatgataaacatctctgttcattttaacttaaaacataaatgtacaacttttactacaataagaaacttttagatttagaagaaatgtgatgatttcctgaataacctttctactgtttttcataaattaaattattgagtataacataaaattatggactgggggactttggctaccacagaagaaatttctagctttgcaggtaatttttgcccatcttcctctttatatttaaataggtctattgctgtcactatgcatatgattcctatatcacccataatttcattttccaatgaatagtcaacattaatcaactattactgtcatcttcactaaacgttcaggaacacatacttttatagctatcagccaataaactatatttttagttctttttgtgattcattattttctgtagcattgtcaaagttagttcttgtttttctctaagatttactaaaaattaggctgggaattctgctttacctgtggaactgaactgggaattctgttctatttgtaaaaactatccataatgcagatgacttgtaaaagacatccttatagaatctatgattttgaatccaatttatcttaaaacataacttaaaaattttcgtcatgccagaaccccttgatccatatgctgaattaaggaaggcatatttattaattagaaaacaccccatataggccgggagcggtggctcacacctgtaattcaagcactttgggaggccaaggtgggcagatcacctgaggtcgggagttcgagaccagcctgaccaacatggagaaacccctctctactaaaaatacaaaattagccgggcgtggtggtgcatgcctgtaatcccagctggtcgggaggctgaggcaggagaatcgcttgaacctggggggcggaggttgcagtgagctgagattgtgccattgcacaccagcctgggcaacaagagtgaaactccatctcaaaaaaaaaaagaagaagaaaagaaaagaaagtaccccatatattgtcctaatttcctcacaactgagatacagtgaatgcctactgtatttcaggtattaaaagattagtagaaaaaatgacatctactcaaaggtgagaacaatgacacaaaaagtgtcacccaaagtcaaagtataccataagaaacatataaatggtgaaccaaagataaagcaggattctgactaagggaattaaaaatgttccacatgtgctgcagaatcaaccatgggtattaaatgaaaagcaagaaggtgagagaaggggaattcaaagagaaaggaatagcttgatcaaaggcacagaggcctgaaaatccgtaatacattttctgggggaaaaaaagccaataaaacatggctgaaatacagaatgtttgggaagaagcagcaaagggtgacagtactatacgaggctttcatagaaaaataacttataggcaaataatgaaagcattttctacaatgataaagaggattcatttcattctgtagatagtgggatgtccctgacacttctggagtaaggtaaaagtgacaagatcaaattggtgtttaggaatagtaactctggtgatagtgaaatgtaagcaatgataaactagaggaagactggataagaaatttttataattaccaagaagaaagataatgagagccttaaatttaagcagtagaggccaaggtggaccatatttggggccacaaaactagcattcataaaatttaaaataatttgaattatacaaatctacatcttctgaccaccatgcagttaaattcaaaaccaatttatctacaaaatctcacaatattaggaacacaattctaaataactcacgggtcaagaataattcaaaagaaaaatttaaaaatattttaactgaataaaataaaacacaatttaataaagtttgtgagatgcagttaaagcagcgcttaaagattaatttatagcactaaacagttttaccagaaaggaataaaggtctccaatcaatgacttcagcttctatcctaaaaacttgaaaatgtaatgcaaattaacccaaaagtaagcagaaggaggaaaataataaagttgagaatggaaatcaatgaaagtggtaacaaaagtaacagaaaaaaataaatgaaagctggtcttgaaaagatcaacaaaatttatagattgatcagggaaaaaagaaagaaggaagttttataattttagagtttacatttaggtctatgatttatttggatcatttttaatacactgagagatggattgaagatcatttgttaatatgcttattcagttattctgcaccatttgttgaaaagactatcctttctccactgaataatctttatacattttttttaaaaatcggttgtccatatatgtatgggtctatgtttgtattctctatttagttctattgattaaattaatattgtttatcgtctatcttgtctacagtattaaactattttaatcattacaatgtgtcttcaagttaattagtggaagtcttcaaactttgctcttacttttcaaagttgttttgcctagtgtaggtcttttgcatttacatataaatttgaattccaatagattattgctatcctatacaaaaataatttttgtaaattgatcttttatcttgcaacttctaagaaatccttaattagttttagtagtgtttggagattctggaaagtattccacatacaggatcattttatcaactcttttctgtattttttatttttttaagaaaatccctatgaaatagtttcggtattttcttctggcctatattttagttcacgaattttcttcaacaatactcaatgtgttgctaagtcaatcctctgagttgctaatttcagttatcatactttttcagttctcgtatttgatgtaattcctagtttctagttctctgccacatactaagtcttcttcccccttaaacgtattaagcacagccatgtatgatagtcccattagctaaatcccctgtgagtctgtttctagtaatatttctcttagtttcttaatcacattgtcttacctccttgaatgtctgactatttttgattgaatgctaaatgctgtatgttttttatgtggccataacttgagattctcaatggtgctaccttcatccaaattaaacttatgttttcttttagcaggcagctagcctaatggccttagaaataacaaatcaccttaatccaatcagaggttaaaattattcaaggctaggattcagtctcagtgacagctgatctatttctagttcaccaatacacatacaatgtagtctattttgacaaactaaattcagaaactgatttaagttaaaagaatgaaagttacccagtttctgactccattaaagtcagaaaattctgactatctattttagtactgaaagctctctccaaaattaaatgctctctatcttctgtttttgtgttaaactccacctggacttctttattaattataaaacaaataaaccatttgcaatgagctataatgctagtcacatggaaaacacgttaggcaaaactactttctgcatatagttgtaattcagtaattgtttcactatcactcagaagagaattattttatacactggttgcatttagtccacaatttaaatcattttcccgcattagagaatagtaaaatgtaagagaaatataaatttcatgtttttaatttgttcaaaattttaaaacattaaattttgtaacactgttgccatgctctgttgacagttatattagaagagggtggaacaaactcataagtatgaggcctccctggttcaaagaaagtagagacagaacattcaaatatatattatttccatttatttgtttttttaaaggggaactttggggtaatgccaaacaataatatttatgtttatagtctagaactttatgtgttcttttgttaaaatttcccaccaattttattctcatttcagaggggaaggtcatacatattttaaaacttcacatatataaaggattaaatagttaaataatgtttgtatttctgacaattttcaactctaccttattctaaaataaagtaacattttaaatgtcttcataattttatttttccaagcctactggtattttcacattattgaaacagttacaaatggggaaaattaccatgtactttatactatttgtatcttttcaaggatacaacttatcaagctatcagatcatttactttactgaaagaatgaatacaaattgatggtggcagtggccagtttggaggagcccctgtggggatgccagctgcagtcagggacgtgtggctggggctgtgcattccacagagcccacgggggtgggacaggtgggagccccgccccctaccaagtcccgtgctaccaggcacagctgcagccgcccagctgcagctctggacccgggcatccctgcactctcggaagcccaggaagccccccctatccccacaggcttggaagtgcctgctcctgttccctggcctctcctcgctcccagtgcccactctgatttcagagaaaagctgtggctgagcctggatgctgtcgccacctggccaggtgtgtgcactcagggtggtgctgacatgacagccctttgctgactcacccacctctggactttggtaaccatggtaaccagcgagcatgggagggtggcctggggtgaagacagatgggtgcaggcttgcagctgcccctcggcgcgaacagcctgggcatcgtggacagcatgtcgatggcagtggaagacagaaaggttaccaggcatgaaggggccggtcctcggtgaaacccccaccttcaggccaaggatagcctgaagcctggggtccaggccatccagtcctgggtgaagttggcacgtcagttctgggtgaagtctggggctcagagtgagaacttcattgatggctgttcagccagccagatggtgctttttccaggcctgcctgtggccacacatggaccaatcagcacacagagccaaatcaggaatgaacttccattcacaatggccacaaaaagaataaaatacctaagaatacagctaaccagagaggtaaaggagcgctacaagaagaactacaaaccactgcccagagaaatcagagatgacacaaacaactggaaaaacattccatgcttatcagaggaacaatcaatattgttaaaatggccatactgcccaaagtaatttacagattcaatgctatgcctattaaactaccactgatattctccacagaactagaaaaaaactattttataattcatatggaaccaaaaaacagcccaaatagctaaggcaatcctaagcaaaaagaacaaggctgagacatcatgctactcaacttcaaactacactacggggctacagtaaccaaaacagcatgggattgccacaaaatcagacacacggatcaatggaacagaacaaggaacccagaaataagactgcacacctacaactatctgatcttcaacaaacgtgacaaaaacaagccctggggaaaggattccctattcaataaatggcgctggaataactggctagccttacgcagattattaaaactgaaccccttccttacaccatatacaaaaattaactcaagatggattaaagagttaaatacaaaactccaaaccataaaaactctgaaagacaacctaggcaataccattctaaacataggaactggcaaagaattcatgatgaagatgccaaaagcaattgcaacaaaagcaaaaattgacaaatggaatctaattaaactaaagagcttctgcatagcaaaggtaactatcaacaaagtaaacagaaaacctaccgaatgggaggaaatttttgcaaactatgcatccaacaaggtctaatattcagcatctataaggaacttaaattcacaagaacaaaacaaacaaccccataataagatgggaccttctagttgcaagaaaataagcttagggctcccactgattctaccttatggtgagttttataattgtttcattatatattacaatgtaataataatagaaataaagtacacaataaatgtaatgcacttaaatcatcctgaaatcatatccccctgcccacagtccatgaaaaaactgtcttccatgaaactggtccctgatgccaaaaaggttggggaccactgctctggaacaaatggacctaacagacctatacagaacattccacccaacaacagaaggataaacattttcctaagcacacattaaacattctccaggatagatcaagttaggccacaaaacaagtcgtaacaaatttatgaaaactgaaatcatagcaagaatattttctaaataaattggtatgaaattagaaatcaataatgggaggaaaaactggaaaattcacaaatctgtggaaattaacacactcttaagcaaccaatgtatcgaagaataaactaaaagagaagtaaaaaaatatcttgagaaagtgaaaatgaaaaaaataacgtatcaaaccttatgggatgcagcaaaagcagttctaagaggaaagtttatagtaataaatgcctacattaagaaaaaaacaaagatctcaaacaaacaacttcactttatacctcaagaactagaaaaagaagagcaaactaaatcagcggaagaaaagaaaataataaagattagagtagaaataaatgaaatataaacaaggaaagcaaaagaaaaaaatcaacaaaactaagaggtggttttttgaaaagacaagcaaaattgacaagcctttagccagactaggaaaagagaagactcaaataaataaaatcagaaataaaacagccaacactacaattgatatcatagaaatagaatcataagagattactatgaacaatcatatgcaaacaaattgaataacctagaagaaatgtatcaattcctagaaacataaaacctactaacactgaatcatgaagaaataggaaatctgagtagatgaataataagcaaggagactgaatcatacagatcataaaaagccatataaagactacagaaaaagaaaattacaagctaacatccctggtgaatacagactcaaaaatattcaacaaatggaattcaacagcacactgcaaacatcctataccatcatccccagtaggatttatccctggagggcaagaatggttcaatatatgcaaatccataaatttagtataccacattaacagaatcagtatcacatgatcatctcattaaatcacaaacaacatttgataaaatccaatatattttaatgataaaaactctcaacaaattaggtaagaaggatgtaccccccaaataataaagtctatatatgtcaagtccaccagtaacatcatattcaatgacaaaaagcttttcctctgaaagtttttcctctaacatcagagacaagcaattatgaaaccacctttgcaaaattatgactgagacagtgaaagagatctaacttaaccgactccatcttgcttctaacctccaagctgtccttgtttgttccttggcgtaggctgaactaactttgggagaaatgtagtttatagtttaaaaaaagatggtaacagccctttcccaaagcagacctccttctggcctggggactagattacatttgtgggactaacattagccacaagattagaaattatggtttaggagtcatacagctggaagctacaagattctgaccctccctgaattgctcctaagatcagagtttgagatgttttgcagaccctgcacttgacagatcagctggcaccactcagatcaataaactggctcatctgatcttgtggcccccacccaggaactgactcagcacaagaagacagcttcgactccctatgatttcattcctgaccaatcagcactcttggctcactggcttccccctaagttatccttaaaaactctgcccccttggccgggcatggtggctcatgcttgtaaccctagcactttgggaggccaaggcaggtggatcacgaggtcaggagatcgagaccacagtgaaaccccgtctctactaaaaatacaaaaaattagccgggcgcagtggcgggtgcctatagtcccagctactcagggggctgaggcaggagaatggcatgaacccgggaggcagagcttacagtgagctgagatcacgccactgcactccagcctgggcaacagagcaagactccgtctcaaaaaaaaaaacctctgccccctaaatgcttggggagactgatttgagtaatgataaaactctggtctcctgcacacctggctgtgtgtgaattgcactttctctattgcaattcccctgtcttgatgaatcagctctggctaggcagcaggcaaggtgaaccccttgggcagttacaattagacacgaaaaagaaataaaagacactcaaaatgtaaaagaagaagtaaaaaatatctttgcagatgacataatcttatgtatacatagaaaaccctgaatactccaccaaaaatctgttagaagtaataaacaagttcagtaaagtcgtgaaataaaaacatgtgttggtaaaaaaaagtgttggtgaaataaaagcatgtctaatgaccaaattcaaactctccattccccaaactatacctttttctataatatttatttcagaaaattattctaagacaaaaaccttgcctctttccatccctaatctctattttcagtgagtgcttcaagtttttgctatatgggccaaaaagatctggccagagaagaggcaaagagaggaaaaaaggaagaaggaaaaaaggaaagacaggaggaaaaagagaggcggaaaaatagaggaattacggcagtacatacaccacaatgttaacagtggttatctctggttgaagagattatgagtcatcttcatatttttctttatacacctttctgtattttggagattgtccttaaaaactgtgcttcctttttcatgagagagagaaaaaaagttgttttgaaaatgtctttaatgatattctgaaagaactctaagcccttcattatgtggttcatacacctcctgccacaccccatacccttgtatcttttcatatctgtacctctgcacaagcagctatctcttcctagaacattatccccatttacctgcacctggctaattcctattcatccttcaaaactacacgtgtaccacttcctccataaaatcttcttgtaccacaaacctcattacaggttcatgcctctaatcccagcactttgggaggccaagatgggcagatcacttgaggccaggagttcgagacacgcctggccaacatggtgaaaccccatctctactaaaaatacaaaaattagctaggcttggtggcacacgcctgtaatcccagctactcaggagtaaggcaggagaattgcttgagcctgggagacagagtttgcagtgagcctaaattgcaccattgcactccagcctgggcaacaaagcaagactctgtctcaaaaaaaaaaaaaaaaaaaaaaataggtcataagaaaatagcagttttcaatcgtttttttctggctgccacaaacatggacacacccaaagttatgcattcttcccacaacaagctaaataactctactcctaatagggtatgaagcctcacagtgtttgccagttatactgcctcttctttaaaagcaagccaaagcagtctaatttacaaagccaagaatgacaagagaaaccaattttaatttcctaaccacaaatgattagcacaggaatgactagctgaagcctgcactgttaagaactctccatattggataatatgggagagacggctggctgttcaccagtatccattttccatattatatatggcaatatgcctaactcaaacaaatacacactaaatttctctgcctcctttgtagtcagacatggttacacatcagttctggccaaagagataccagtaggagtgattggtacactttcaggaaaattctttttaaaaggaggaagagggtgggcgtggtggctcacgccagtaatcccaacaaggattgcttgaggctaagagctcaagaccagcccaggcaacatagcaagacctccttctctacaaaaaaaaaaaataataattaaaaaataaggattagccaggcctggtggcacatatctctagtcctagctactcaggaggctgaagcagcaagagtgcttgagcccaaaagtgcaagcctgtggtgtcctgtgattgcaccactacattcttggctgggcaacacagtgagaccctgtctaaaaaataaataaataaaaatagtaggaagactcggttgcatttttagcactgttcccctttcctcttccttctgtgtaggacgagaacatgaagataagagtgatatcctatataggaaggaatagaaagctggacagagcatgagtctttgacaacatcacaaagttactgttaacagccccaaatcacctaccttgtctttttttttttttttccaacagggcagaaaaatacatccctacctcatttattccattatagtttgagcattctgttacaggcatttagttgaatataagcctcagtggaggctgaggataactagtggaactaaccgaaatctctatccttggggcaaaggagtaatataattgagaatgacaaatataaccaagagtgaaaagacaaactctaatgctgagcacccaaagagtttctgttatgtctttgaaataagaacgcagggtttcatgttgtctgagcttcattgcaggccagagcagcaactaaaatagcattggtttctcttccatttaaaaagatatcagaatgcagataagtgagaataaccttatcttacagatacccttaaatgcactcttttaaaaatttttaataaaacagtcacaagttttggcagtcaaattatcagaaccaaattaccagtactccgtcaccctccgtattctagcatccttatctggcatgcagttaaacagacaggctctatttaaaacattgaatgaacagaaatggatatgcataatttatttaaatagtgatagatggaaggaaatcaaagagaagaaacatccaaaactatatgacctttacagatccaagaataactaggaacagttctgtttatatgtggggcttcctccagtctgacagcattcctcagactgtccctttcatctggaaatttcccaaaaaacccagctttttcagctgagtctttagactagttttagctcctctaagcatgcaaattgcttcctatatgtttcatgaaaatatcagggaatgtatgagggtcgaagacagcataaaacatgaagtccaaaggactagataaattcactgagggacaaagctaatgtcattaagtgaggtctagtaggagaaaaataaaagctgaaatcacaactctgaacttaagctaaacacagtgtccagatgagaatgacagaaagtgggcaataaacattttcaatatggttctttaaaattcaaaaagaattgtaattacagcaaaaaaaaattttcaaagactctctcacatccctaaaatacacaataatgacaagatttaataattaaaattgcacaactaattttccacaccttggatctacaagtttcagagggcaaaggtggccaagtaaggaaagaaaatgaagtctcctagaactgctcctaatgaaagaaatccttttgataacattaggttttatactgaaaccacagcattatttttgaaaacataccctaataatgacaataagagtagcaacagattttacttttatgcttactatataccaggaaccattttaagcacttgatgtgtattaagtaatttgatccatatatctctcccttccagacatataccaaacacaaattggataagcaacactttaaagtaaactaaaagaaatcaatcacatttcctattcaaatgaaatgcagagcctttaagattttagtactggaaacatttaatagatacataaggatcaaatgacttaatatacatagagtgcttaaaatggttcctggtatatagtatatgaagtttatccccattagactgataaaaagaggtatagagcctttaaataatttgcccaaggtcacagtgttaccaagtggagaagccagaactaaaactcaacaagactgttctagagtccatgatattgaccactgtaccaaattactttgtaagtgttataccttaagttcatttagagagtcaagctggacaaagctgaaattatttctggcttctcactactctatcaaggtagtgcttctctcccagttatccaaatttgaatcagtgagataacttttggtgcctcagtgcattccatattcaattagtcatccaaccaaaccctgtcaattaaatactccattcccactcatattgtcaccatcttggatattccacagtcaaaaactgcatcagcttttctataagctaatagctcatgccagccttattaataaaacatctaggtctttttcacatgaactgcaggtcttacatcataattttgtaggacataattataataaaatattttacatttcctcaaaaaaattcactttattaatttcagtccattattccagcctatatattaactcttccttccagatatataccaaacacaaattggataggcaaaactttaaactaaaagaaatcaatcacatttcctattcaaaagaaacacacagcctttaagattttagcactggaaatatttaatagaatcgatagtcaaagacagtagctgaatcaagtgaccttttaacacataagttacactttggagtggggcgctcttagttcagttaccaaaatcctaatttatataactgttacgggagcacggtgcttcctttaatctatcttggttccactgagtatcactgagacagtttgaagactaaaaagactaccaaatggaaacaaccaaacagctaaaaacagtccacagcatacaataaatcacagtgctctccaacctttttcacttcatgcaacatagaggatgttatctatacacccataccacagctaatcacaagactgctcacagtcagagatctcaatatctcaacacacttagggctaagccaagtgcctcagggcatctcttagcaagtttcacactaaactaccacaatttatttgctctcagcattaataaatcctcatctattccaaaccagatagtcatccaaaaccttggaacaactctgaaggtccctcatatggattccttgcttcccagctccctttacaactggatgtgaaaggtgctgtcttctgtactttctcttgagaggcagaaagaaataaacaatggctaattctgacctatacctcgggccctcctattttctatttttaatctggagaaatacctattctagcagcttgggtaacttactatataaatgattttggtctttaggtgagctcttgcctccacagacaagggacagctacctgatccaaagcgctaaggtgatgtgagattgtaagatataatgcattgctattggtatttgaagcttgccacagatattaatccagtgtgatatggattagatcaactttacattatccaatgccttgcccatgctttcatgccctaatagcaatacagctaacatccctaaaaatgactgccagaataatagcaagagctcatggccccattagcaatagttggcactagtttccagtttccaatatgatctgttgcaaaattagccaaaaatgatgtccaaagatttgccgaagttgaatttctttttgaaatgcagaggacaacttcattaagattctactagtacactgtagcattgtacactgtaccagcactaaacagaaccaaatctccatcccagtcacttcaactagatagtatctaaaatctcacccttagtataatgtacttaaatgagatggaaatactccacattctgccctgcctaagttctagaaatttttattaggttaagggttctatatttataacttaatgacacatccatacatattaggaccttcaactcttgaaaaaggaatttgaatatgtatgtattttaatacaaatttagcaaataggcttctgagaagaaaaagatctcacagtattttcaattatagtaactgtacttttagcatatgtcaagttaatggtcctataaactcacagaaaagaataagactcttaaagataatatgtatcaatgaaggcgagtatacatacaagaggaagttcacaatcactttaaaaaccatacaataccgagtccataagggcattgccacattggttttatttaccactatattcccagcacccaataccttgactagcacataataggcactaagaaaatacataaggctgaatgaatcatagcaaatatttaatataaactaaaattagatgatcacttgacaagggtattgtatacaaacttatttaatcagtaaaaggaaggttagaatttgaccaggaaatctttaaggtgctttccaaacctcaagacttcataacattttcatcactatgccagtgaaagtattaaatgaaggtcatactctattatagaaaggactactagaaacatgtctatcaataaccacaggatgcattataatctaccagtcagcctttttatacaaataactgtcaagcgggggtgggcaggggaagggaccacaagagaaaccataaaacattagtaatcttaaaggataaattaatcttgtttatatacttctatatttatacacaaaaaaatgttaatctaaaaatgactaggtctatgaattgtgttaaaagaacaaatccaaaaatgatgtattaataattagggggaaaatccctggtatcgaaagtaatagaattattttttccttaaaagctgcaaattagctgggcatggtggctcattcctgtaatcctagcactttgggagaccgaggtggggagaccacttgaggccagcagttcaagaccagcttggccaacatcacaaaacccatctctactaaaaatacaaaaataagccaggtatagtggcgcatgcctgtagtcccagccactcaggagactgaggcgggagaatcacttgagcccggaagtcagaggttgcagtgagccgagatcatgccactgtactccagcctgggcaacagagcaagactctgtctccacacacacacacacacacacacacacaaaaaggctactaattgaaaagttcagtaccagttaagcaactgctcagttacagaattagtttagaaatacacaggatttttatacttgtacttaatgataagctgcaaatatctgactatatttccctactcttttctctgtccttctataaaatacaaatatttttgaaatttttgaattatatacaaataggtcacacattaaataatggttaatttaacgcaagaaactaatgtccaccgttaatgaacttcacataacttcccataatatacttcacattaaagatattttcttcagtaatttgttaagattaaaagtctagttacaggccaggcgtggtggctcacgtctgtaatcccaggaattctagaccagcctcagtaacatactgaaccctggtctctacaaaaataaaaattaaaaaattagctgggcaaggtggctcatgcctataggcccaacaacttggaaggctgaggtgggaggatcacttgagctcaggaggtccaggttgcagtgagccctgaccacagactgtactccagcctgggcaacagagcaacactgtgtcttctaaatgaataaataaataaataaataaaatctagttgcaatttgcttggtaatataggaaatatgaaaaatgctaaaagctattttacctagatcatttgcttttcttagactctgtttggcaaaaagcagcaggaaactggttgccttgatgaagtaataggccacggccaagcacggtggctcatgcctgtaatcccagcactttgggaggctgaggaaggcggatcacctgaggtcaggagttcaagaccagcctgaccaacatggtgaaaccccatctctactaaaactacaagtatcagctgggtgtggtggcacgtgcctgtaatcccagctacttgggaggctgaggcaggagaatcacttgagtcccggaggtggaggttgtggtgagtagagatcgtgccactgcactccagcctctgcaacagagtgagactctgtctcaaaacaaaaaacaaaaacaaagtaacagaccacattccacccatcactgttttactgtttttttacagtacttatcaattatcacatactacataatttactaacattatggttagtactggtctctctccactagaaatttaagttctgagaagacagcttttatctggtttacagctatatcttcaaccctgatctcagttcctggcacataataagtaccaaatagatatctgttaaatgaatagactagaatctatcattgctaaatattcaaaaaggctataaattttaaagtaatattctgcataaatgagcaacgaccaaaaaaggttgtttttctctaagtacctgcaagccagctgttggtgatctttaactaacttattagtttctagactccacccttacccctgtttcatgttcaagaaccaattcttcccttttactaatatcagcatcacatggtcattctactcaaatttgtcactgtcaccaataggaaacaggctgctatgcgagatgaaattacagataatacccaggtagaacaatattaatccaggtaaatatttatatgaatttgaaatgtaccttccggaaattttaaagaggccagaatcagtctaaaagaatctgtagttaatagaatgagtggaagatattatttatgagcaggtggctttcctgtgctgcttctcaactaaggacatgtctcttcttctgcttctttggcttgtcagaaagtaaaatatttaaaacaacgcagggttccacctcatctttttatcaaagctcagaagtctcaggaaaaacagttatactgcataaggaaaaagaaagtgaacttcaagcaatggaaaccacaataaattaaccaattgagcacatttttcacacaagttttaaagcagtttaatactctttccaaagtaagtacataatattgtactgtttttctttcttttgaagagcatttaattggagaaaaatactgaagctgttagtactctcaatgaaatcttttttgaatttttaatttttatgggtacacaggtatatacatttatcaggtacatgaaatattctgatatgcatataatgcataataatcagtaaatggggtatccatcacctcaagcatttatcctttgtgttacaaaaatgcaattatactcctttagctatttttaaatgtacaaaaattattgttgactgtagtcaccctgttgtgctataaaacactaaatcttattcattctacccaactatatttttgtgcccattaatcttctccattacctcctctcccccgccacactacccttcccagcatctggtaaccatccttcttctctctctctctatgagatcaattgttttaatttttaactcccacaaataagtgagaatgtgcaaagtttgtctttctgtgcctagcttatttcattcaacatgacttccagtttcatgttgttgcaaatgacagaatctcgttcttcttatggtcaaagaatactccattgtgtatattgtcacattttctttatccgtttgtctgttgatggacacttaggttgcttccaaatcttggccattgtgaatagtgttgcagtaaacatgggagtgcagattatctcttcgataaactgatttcctttcttttgggtatatgcctagcagtggaattgctagatcatatggtagctctattttcagttttttgaggaacttccaaactcttctccatagtggctttagcaatttacattcccactaacactgtgtgagggttctcttttctccacatccttgccagcatttgttgttacctgtcttttggatataagccattttaactggggtgagatggtatctcgttgtagttttgatctgcatttctctgatgatcagtgatgctgagcaccttttcatataactgtttgccattcatatgtcttcctttgagaaatgtctattcagatcttttgcccagcttttaatcagattattagattttttttcactacacagttgtttgagctccttatatattctgtgggttgtctcttcactttgttgattgtttcctttgctgtacagaagctttttaagttaatgtgatcctatttgtccatttctgctttggttgtctgtgcttatggggtattactcgaagtctttgcccagttcagtgccctagagtttctcccatgttttcatgtagtaatgtcatagcttgaagtcttacatttaagtctttaatcaattttgatgtgattttttttatggcgagaaagaggggtctagtttctttcctctgctatggacatccagtttcttcagcaccatttactgaagagactgtcttttctccagtgtatgttcttggcacctttttcagaaatgagttccctgtagatatacagatttgtctctggattctctattctgttccattggtttgtgtgtctggtttcatgccagtaacatgctattttggttactatagctctgtagtttaatttgaagtcagataatgtaattcttccagtttttttaattttatttttatttttatttttttgctcaggatagctttggctattctgggtctttttttgcctccatataaactttagaactgtttattctatttctgtaaagaatgttattgatattttgacaaggactgcactgaatctatagattgctttaggtagtataaacattttaacaatactgattcttccaatccatgaacatggaatatctttcctttttttgtgtgtcctcctcagtttttttttcatcagtgatttataattttcattgtagagatctttcacttctttggttaattccttggtattttatctgtagctactgtaaatgagattactttcttgatttttttcagatagttcactgttggcatatagaaatgctaatgatttttgtatgctaactttgtatcctgcagatttattcaatttgttcatcagttttaatagttttttggtgaagtgtttacatttttccagatataagatccatcatctgcaaagaaggataatttgactccctcctttccaatttggatgccctagacttccttctcttatctggttgccctagctagaacttccagtactatgttgaataacagtggtgaaagtgggcatccttgtcaccttctagatattagaggaaaggctttcagttttccccccattcataatgatattagctgtgaatctgttgtatatagcttttattgtgttaaggtatgttccttctatacccagtttttaaacagtttgtatcataaagggatgttgaattttatcagatgctttttcagcatcaattaaaatgatcacacggtttttgtacattctgttgataaaatgtatcacgttgattggtgtgtgtgtcttgaaccatccttgtatccctgggataaatcctacttggtcatgatgaaggatcttttaaacattttgttaaatttggtttgctaagattttattgaggattttttgcatcaatgttcatcagggaaattggcctatggttttcttttttgctgtgtctttgcctggttttggcatcatagtaatactagtctcatagaataaggtttggaagtattccctcctcctcaattttttggaatagtttgagtcgaaattgcattagttcttctttaaaagcttgatattaatagaattcagcagtcaagccactggatcctgggctttcttttgctgggagactttttattacggctttgatcttgttacttgttattggtctgttcaggttttggatttcttcattgttcaatcttggtacgttgtaaatctctgggaatttatccatttcttccaggttttccaatttattgacatatagttggtcacagtagccactaatggtcctttgaatatctgcagtatcagttgtaacgtcttctttttaatctctggttttatttatttgggtctttatttttttcttactcaggctaaaggtttgtcaattttatcattacaaaaaaaccaactttttgttttgttgatcttttgtattgttttcttaatttcaatttatttctgctccgatctttattagtttcttttcttctcctaatcttgggtttggtttgctcttgcctttctagttctttaagatgcatcattaggttgtttatgtgaagtttttcttcttttttgatgtaggcacttatagctacaaacttccctcttaatactgttttcactatattccataggttttggtatgctctgttttcattattgtttgtttcaaaaaaaaatttttttttttgagaaggagtcttgctctgtctcccaggatgaagcacaatggcgcatctcagctcactgcaacctccacctcccaggttcaagggattctcctgcctcagcctcccaagtagctgggattacaggcacctgccaccgcgcccggctaatttttttattttttagtagagacggggtttcaccatgttggccaagctggtctcaaactcctgacctcaggtgatccaccggcctcggcctcccgaagtgctgggattacaggtgtgagccaccacgcctggccaatacaattttaaatttcttttctttttttttgagatggcgtctcactctgtcgcccaggctggagtgcagtggcgccatcttggctcactgtaacctctgcctcctgggttcaagcgattctcatgcctcagcctcccgagtagctgggattacatgcatgtgccatcatgcttggctaatttttatattttttagtagagacagggttttgccatgctggccaggctggtcttgaactaccgatctccactgacccgcccaccttggcctcccaaagtgctgggactacaggcatgagccagcgtgcctggccttaatttccttcttaaactcttcatggacccacaggtcattcagcagcatattgtttaatttccatgtgtttgtatagtttccaaaattcctctttattgatgtctagttctattctattgtggtcagagaagatacttgatattatttcaatgttttcgaatttttaaaaacttagtcaggagaggagccaagatggccgaataggaacagctctggtctacagctcccagcgtgagcgacgcagaagacgggtgatttctgcatttccatctgaggtaccgggttcatctcactagggagtgccagacagtgggcacaggtcagtgggtgcgtgcaccgtgcgcaagccgaagcagggcaaggcattgcctcactcgggaagcgcaaggggtcagggagttccctttcctagtcaaagaaaggggtgacagatggcacctggaaaatcagttcactcccacccgaatactgcgcttttccgacaggcttaaaaaacgccgcaccaggagattatatcccccacctggctgggagggtcctacgcccacggagtctcgctgattgctagcacagcagtctgagatcaaactgcaaggcggcagcgaggctgggggaggggcgcccaccattgcccaggcttgcttaggtaaacaaagcagcagggaagctcgaactgggtggagcccaccacaactcaaggaggcctgcctgcctctgtaggctccacctctgggggcagggcacagacaaacaaaaagacagcaggaacctctgcagacttcaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcagactgacacctcacagggccgggtactccaacagacctgcagctgagggtcctgtctgttagaaggaaaactaacaaacagaaaggacatccacgccaaaaacccatctgtacatcaccatcatcaaagaccaaaagtagaaaaaaccacaaagatggggaaaaaacagagcagaaaaactggaaactctaaaaagcagagcgcctctcctcctccaaagcaacacagttcctcaccagcaacggaacaaagctggacggagaatgactttgacgagctgagacaagaaggcttcagacgatcaaagtactctgagctacgggaggaaattcaaaccaaaggcaaagaagttgaaaactgtgaaaaaagtttagaagaatgtataactagaataaccaatacagagaagtgcttaaaggagctgatggagctgaaaaccaaggctcgagaactacgtgaagaatgcagaagcctcaggagctgacgcgatcaactggaagaaagggtatcagcgatggaagatgaagtgaatgaaatgaagcaagaagggaagtttagagaaaaaagaataaaaagaaatgagcaaaccctccaagaaatatgggactatgggaaaagaccaaatctacgtctgactggtgtacctgaaagtgatggggagaatggaaccaagttggaaaacactctgcaggatatcatccaggagaacttccccaatgtagcaaggcaggccaacattcaaattcaggaaatacagagaacgccacaaagatactcctcgagaagagcaactccaagacacataattgtcagattcaccaaagttgaaatgaaggaaaaaatgtgaagggcagccagagagaaaggtccggttacccacaaagggaagcccatcagactaacagcggatctctcggcagaaactctacaagccagaagacagtgggggccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcgctaaacatggaaaggaacgaccgataccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgttctgtattcaggaaacccatctcacgtgcagagacacacataggctcaaaataaaaggatggaggaagatctaccaagcaaatggaaaacaaaaaaaggtaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagtcaacaaggatacccaggaatggaactcagctctgcaccaagcggacctaacagacatctacagaactctccaccccaaatcaacagaatagacatttttttcagcaccacaccacacctattccaaaactgaccacatacttggaagtaaagcactcctcagcaaatgtaaaagaacagaaattataacaaactatctctcagaccacagtgcaatcaaactagaactcaggattaagaatctcactcaaaaccgctcaactacatggaaactgaacaaccggctcctgaatgactactgggtgcataacgaaatgaaggcagaaataaagatgttctttgaaaccaacgagaacaaagacacaacataccagaatctctgggacacattcaaagcattgtgtagagggaaatttatagcactaaatgcccacaagagaaagcaggaaagatccaaaccggctcctgaatgactactgggtgcataacgaaatgaaggcagaaataaagatgttctttgaaaccaacgagaacaaagacacaacataccagaatctctgggacacattcaaagcattgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgcatccaggagctggttttttgaaaggatcaacaaaattgatagaccactagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacatatacaccctcccaagactaaaccaggaagaagttgaatctctgaatagaccaataacaggagctgaaactgtggcaataatcaatagcttaccaaccaaaaagagtccaggaccagatggattcacagccgaattgtaccagaggtacaagaaggaactggtaccaatccctctgaaactattccaatcaatagaaaaagaaggaatcctccctaactcattttatgaggccagcatcatcctgataccaaagcctggcagagacacaaccaaaaaagaaaattttagaccaatacccttggtgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcacaaaaggcctttgacaaaattcaacaactcttcatgctaaaaactctcaataaattaggtattgatgggacgtatctcaaaataataagagctatctatgacaaacacacagccaatatcatactgaatgggcaaaaactggaagcattccctttgaaaacaggcacaagacagggatgccctctctcaccactcctattcaacatagtgttggaagttctggccagggcaattaggcaggagaaggaaataaaggctattcaattaggaaaagaggaagtcaaattgtccctgtttgcagacgacatgattgtatatctagaaaaccccattgtctcagtccaaaatctccttaagctgataagcaacttcagcaaagtctcagcatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctctccaaggagaactacaaaccactgctcaaggaaataaaagaggatacaaataaatggaagaacattccatgctcatgggtaggaagaatcaatattgtgaaaatggccatactgcccaaggtaatttacagattcaatgccatccccatcaagctaccaatgactttcttcacagaactggaaaaaactactttaaagttcatatggaaccaaaaaagagcctgcattgccaagacaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaacaagcaatggggaaaggattctctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataagcatgggcaaggacttcatgtctaaaacaccaaaagcaatggcaacaaaagccaaaattgacaaatgggacctcattacactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaatcccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgactcagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcatgtatacaccatggaatactatgcagccataaaaaatgatgagttcatgtcctttgtagggacatggatgaaattggaaatcatcattctcagtaaactatcgcaagaacaaaaaacgaaacaccacatattctcactcataggtgggaattgaacaatgagaacagctggacacaggaaggggaacatcacactctggggactgttgtatggtggggggaggcgggagggatagcattgggagatatatctaatgctagatgaggagttagtgggtgcagcacaccagcatggcacatgtatacatatgtaactaacctgcacattgtgcacatgtaccctaaaacttaaagtataataataataaattaaaaaacaaacaaaaaacaaaaacaaaaaaacaaaaaaaaacaaaaacaaaacaaacaaacaaaaaaaacttatttttgtcacctaatgtatggcctatccttgagaatgatccatgtgctgaggagaacatatattctgtagctgctggatgaaatgttctatagatatctattaggtacatttgttttatagtgcagattaagtgtgatgtttctttattgaactttctgtctcgatctgtccaatgctgaaagtggggtattgaagtctccagctattattgtactggtgtctattctttagctctaataatatttgctttatatatctgggtgctccagtgttggatgcatgtggcaggacttactcctgccattttgttatttgttttctggttgttttgcagtcttctcttccttgtttccttcctgtcttccttttagtgaaggtaattttctctggtggtatgttttcatttatttttatttttacccccttttgttttgtgtgtatttgttgtatgtttttcaattcaaggttaccatgaggcttgcaaataatatcctataaccaattactttaatgacaagttaacactaattgcataaaagcaagcaaaaagaaaaataaaaactctatactttaactttgttcccccactttttaactttttgttgtttctatttctacctcattgctctgtatatgtcttgaaaagtccttgtggtttttattttttattggttcatcttttagtctttctatttaagaggagtttacacatgacagttacagtgttataagtattgccagtgagttttgtaccttcagatgatgtcttatttcttattaatgtttttttctttctgatggagctattccctttatcatttcttgtaagacaggtctggtgttgatgaaatccctctacttttgtttgggaaagtatttctcccacgtgtttgaagaatatttttgctagatatactatgctaggataaaagcctctttccttcagcactttaagtatatcaggccactctctctggcctgtcaagtttccatgaaataatctgctgtcagacatactagagctctattgtatgttatttctttcttttctctggttgctttcaagatcctttctttatccttgacctttgggagtttgatattacatgtcttgatatattcttctttggattaaatctgctagctgttctataaccttcttgtacttcaatattaatatctttctctagtttggggtaattttctgttattatcactttgagtaaactttctacccctatctctctctacctcctctttaaggccaataactcttagatttgccccattggggctattttctagatcttgtaggtatgcttcattcttttttctttggtgttctgcctgtcttcaagctcacaaattctttcttccacttgatcaattctgctgctgttaagagactctgatgcattccttagctttattgaaatctttcacttggttttgaatccaatagtaaaatctaactttttcattagaacactgtggctgtcataatcaaagctattcctaatttcacagatattagaggtttttctggtaaatatggtctatctttggaaaaaataaaagctgccaactctctaagcaccgagtactcatgtcattacactcttctgattttaatgttaaaatgctttttctctaagtgtctttctaacgccacttaaaccatcctaattggaatctagggcttagtctattaattttttaagtatcagaaataaagaaaacttttttaaaaatcagctttctcatataatactactagcagaatagttttagaaaagctttagcagagaatcaaaagaccagggttttattatcatctcagcaattactaagtagctacataacactgagcaagctatgaaatctgagatttcaatttctaatttttttaatgaatgaattttagcatttaagaaataaatataacttacctaaaactgtcacttttctctttggttttctaaatcttaactttatacaaattttcccaatttttgaagtgatttttctaaatttctacatgcagttcagattctagataatttttggccagacttaaagtatctttaagagttagccagaattaactgtttaaaaaagtacattttactaaggacttttatctttataattaatctatgaaattgtgactccctttttagctttcattacatttcaaaagaggtcagaaatattcccaccatcctccttcctggacacatctcaattcaatgcaatagtaaactatttctgaatgttaaatacaagttacataaaaattctcccaattaagagatatgagtataattccaaggcatttcttgaaagtgaggaaagtttagtggtgataataatttgctataaaagtagatacagccatatcattgataaatttatatttgattaatgagcttttagttctcaaagactaaaaaacttttcttcaataaatacacatatgtgtttactttgtcaccttagtaactctcaccctaaaattttgtacattggtgactttttatagacacataagtaccactagaggccaccaaatacttcatcttattaaatcaacagatttgcaagttattctggctagcttaaaggtactttaaattaagctaagttacaaggagatgaccatacatggtaatatccgtaactggaaactctcaaagaattattcaaagtcaagcaaaaagatgtaaacatatttcgtacagtaattaggatgtatggatgtatagatgtataattcgacaaaaagctttatgagatcaaaatgggggggtaggtaatataaaaattcattccttacgtacctttgaaagtagacctagagagatgacctacaggaatgacctagagagatggtgttctctcaaattgctgttgtcctttataagcaaattatgtatttaaatatacacctctctatatatacataaatataaacatacagatacataaaatcctagagttcagtattctttcttgcatatcacaaagtctttcacataatgattttaatatctcaagttggctaccatttacagcaatcaaaacttcaagaaagaagtcttattgtcaaaatcacctgactttttttttgtctgtttattttaagacagggtcttactctgtcacccaggctggaatgcagtggtgcaatctcggctcactgcaatctctgcctcctgggctcaagcgaccctcccacctcagcctcccaagtatgtggaactacaggcaagcaccaccatgtccagctaatttttctatgtctttttgttgttgttgttgttgttgttattgtttgtttgttgttttttaatttttttttttgagacggagtcttgctctgtcgccaggctggagtgcagtggcgatgtctcgtctcactgcaacctccgtgtcctgggttcaagtgattctcccgcctcagcctcccgagtagctgggactatagcacgcgccaccacgcccagctaatttttgtatttttagtagagacagggtttcaccatgttggccaggatggtcttgatctcttgactttgtgatccgcccgcctcggcctcccaaagtgctgggattacaggcgtgagccactgtgcctggccagtttttctatgctttgtggagacagggtttcaccatgttgcccagggtgatcatcaccccacattttctaatatacccaaaattctggcttgaagaagaaaacctggcatctggcaaaaataacacctgagtaaactttgctctccctttctaggtgaaagcgctgcttaaagcgtcccacatcctctcatttcttccagcgtcctcctcctttccaatggtaaatagtaaaaactagaaggcccaagtagcatccaaagattctgtagatccaagggaaacttctaaaaaaaatggggcttattgctattgtattatccaccttttctgcatggttatatactatttttcaaggtttttcaggaaatccagagaaactttaatcagtcacggttttgacattctctctaaaaaatcttggcttaactaaaggtctcaaaatcctaagttttcttttaaaaactttatagtgttagcttttacatttagactatgatccatttcaagttactttttgtgtatggtttaagggtcaaggctcatttttttcctaaatggatatccagttgttctagcaccatttgggcttatcacttccacaactgaattacattagcaactcggtccaaaaaccaatttatgaagtcaggcacagaatgataactactgtgtgttctcatccatatgtagaagctaaaaacacaaaaaacaaaaatttgagctcatagaagcagagagtagaattgtggttattagaggctgggaaggatgtggggagggaaggaaaggaagagattggttaacagacacagagtcatagctaaatgggaaatataagttctcgtgttctgtagcaccgttaaggtgaatatggttaacaataatttagtgtatattttcaaaaacttagaagattctgaacgttcacaacacagagaaatgataggtatttgaggtgatggatacactaatttgattccaccattatacattgcatacatgtactgaaatatcaccctgtttcccataaacatgtagaattattacatatcaactaaaaataaaaggaaaaaacaaaaaagataacacatgcttttctttcaataaagtggaacatttcagaaaaaagaaataaattcatgatatatatgtgagtttgcttctagactgtaccatggatctacatgtctattccttaagctaataccatactgtcttgattattgagccttatgggatgtcttgaaaccaggtagtataagtcttccaaactttgttctttttttcccagatagtttttggctacttgctataaaatatgccttagagatttattcatttcagtacataaagctttatttcatactgttttaaaaagttaactacagtaaaatatatataacacaaaatttatcatcttaacaatcttaagtggacagttcagatagtgttaagtacattcacactgttgtgcaactaaactccaaaactctttccatcttgcaaaattcacaatctatacccactaaacaacttgccattcctccctttccccagcccctggcaaccaccattctacttcctgcctgtatgaatttgattactctatgtctctcatattagtgaaatcacacagtattttgttttgttttttattgttgttgttgttgcttgagacggagtctcactctgtcgcccaggctggagtgcaatggcgtgatctccgctcactgcaagctctgcctcctgggctcatgccattctctcacctcaacctcccaagtagctgggactacaggcgcccaccaccacgcccggctaattttttgtatttttagtagagacggggtttcaccgtgttagccaggatggtctcgatctcctagtatttgtgtttttttgtgattggcttatttcccttaacatagtgtccccaaggttcatccttcaggttgaaccttgcataacacaacaaatgttggcacatgttgtaacatgtgtcagaattttcttcctttttaaggctgaataatattctgggggggggtgtgtgtgtgcgtgcacacgtgtatcacatctcacttgtctattcatctgtctatggacattcaggttgcttccaccatttgactactgtgaacaatgctactataaacatgtgtatgaatatctgtttgaatcccagctttcagttcttttaggatatacccagaagtgaaattgttaggtcatatggtaattttattttcaattttttttgaagactctccataccattttccatagtggctgcaccattttacgttcccaccaacagtgcacaagagttccagtttctccctaatcttgctaacatttgttattttctgggatttttgttttgttttggggctttttttagagttggaatctcatctatcacccaagctggagttgcagtggtgcaaatcatagctcactgctgcctccaactactaggctcaggtgacccttccatctcagcctccccagttgctgggactgcaaatgtgagccactgtgcttggcttttttttttttttttaatagcaataataatgggcatgcaatagtatcttatggtggctttaatatgcatttccttaataattggtgatgttagcatcttttcgtgtgcttgtagatctccttatctcgtactttttaacagctgtactatgttctgatgagtggctgtggtaccgctaattcaacgagtccccatactaatggtcatttagatagtttccaaccttttgcatacaggtaattcatacatacacatatatataagtaaccatacaaatcagttggttctagatagctccagtttatgcatatttttgattcaatccttttcactctcaaaaacattctggtttgaataagacacagttaccctagtttcagattaaggataagataaattgctgaaactgaaattaggcatgaacgagctgtgatttaatcttccaggctatttgttacccagaacttacctcatattagaaatttagtattagaaaaagatatttatatttaccacttgattataaaggatacaactaagaaacagacaagtgggagagatatacagagtgaggtatggcagggaccatgccctctctcaggtgtaccactttcacaagacattagtgtgttcattgggcaagcacagcggctcatgcctgtaatctcagtgctttgggagggcgaggtgaggagattacttgaggccaggagtttgagaccagcctgggaaagacagactctgtctctaagaaaaataagaaaatagctgggcatggtggcacacacctgtagtcctagctattctggacactgaggcaggagatcgcttgagtccaggagttcgtggttacaatgaactaagatcacaccactgcactccagcctggatgacagagtatgtaagatcctgtgtctctttaaaacaatcaaaaaaaatgtgttcatcaacccaaaagctctctgagccctgttatctaggggttttaatggaggtttcactaagtaggcataactggttaaatcattgccattggtgactaaactcaatctccagcccttctctctccccactgggggtgaaagttccaacccactaaatgcataattgcttcctctggtgaccagcccctatcctgaaactatttagggcctctcaacccaagagccatctcactggcatataaaacacagtaaatcacaaaggtttcaggagctctgtgccagaaactgggggcaaagaccaaacatttattttttcattataccacaaagaccaaattaatgaggtcaaaaaataaaatggtcaaggaaaattaagataagggaaacaatctttggattcagcatgaacagtgtggcagaggaaagctatttgttcagtaaatctgtttccttcttctcctaagcacacatctagggtttatttaccaatctcctattacagctaactggctttgtgattgacttctgattaatagaatatggataatatatactgcctccagacatatcccataaaactaacttttactatcctccatgctttctcttactactctgacgaccaactactgctgcctaagaagaccctgaggactgtaaccaagtacccccatttttctgtaggtgatttaattattctctttttcctctctctcctctctctctctctctcctttttctctcctctctctctctctctccctgcgtcccctctccacctgcctcagaacttacacctacttggagggcttgctgaaagcatgtccacttggcaccttttacaacttttcccaggaaggtgccaacccaactgcctagtagataactgcctggtagcagggggacccctgccttcgctcatctcctcccctgccttataaaaatgcctgctttctgctccaaaggtgaagtgggacatttaaaagaagaatgctttgtgcctcttccccccaatgagctttggaataaactcactttttttttttttaatcagacatcactcttgttaattgaactctacatttagtgggcatctaacttgctttttcgttacaagaccacattttgaaaatggcaaaccccactcccatctaccctactgccactaattagccattatgtaaataaggggaaaaaaaaccttctattatgttaagttactaagatttccaggtatatctattacaaaagctagcattaccttaaccaattcagaaaaaattaacttcaactttgtgatttcagaacagacaggacataaactatacttcagaataaatccctgcaatgtgcgtgagatagaggtatgaaatgagagtaaataacaacaaattgtaacattacaaatattaaaatattaacagatgatcatctaataacatccctgtaggaaaattattattatcagagagagtaaattaacttcgctcaaggcttttaaatttcaaatcccgtattctttctactgaaccacattagtctcttagagaaattgggacagcaaatgaagactcactgaaaacattttataataaagaagaaataggatagtagctaaaacataaagtcaagaaatttttttttgctaaaattatagatacaatggaaatgggatgaatagaaatagaatagtagcaaaaaggaactggaacttaagaagtacaggataagccataagggtgatatgacagacaagcacatgagagatgagtagcagtatgataccatgtaacgaagtccaggctgtccgcaaacaatacacagatgtagtgggtcaggcctgtgtagctctacatcttcctcaggaagttctctttggtcttaaagcatcaggtagagcagaaccctagcatgacaagaaaactttgtctaaagtggttctgagagcagaagtgaagtacgtgactgtaggggaaagattttctagcataactgagggtatcgatgcactgacaaaataagcagaattgagagacactagttctagtacaggataaacaaaccattgtagtgagtatggaggagtgtattagaatcataacaccaagattaattaatctcttcctcagagatgataaaataatctactacctcacatgcactttccagacttcatgaggttccctgccctgtggttttattacttcaaagagacaacagtctgggagtgggtaccaaaaatatgagctcaaaccaccattttctagcttaaactccatttatatccacttgctttgttgtgaacataacttttaaaatcctttttatagttcttagtatgttttaaaagccaggtcttcatacttcgtagcagttttcttaagttttcagcctcaactctatgccaaatcaagagtccttccacacacggtttataccaagctttggaccatctttaaaactgtgtattttacctcgcaccttacctcaggacagaggctttagattccatctacagtatctaccatacataccttttataaactttttaaaatctgtcttcttctatttctcaaacctctctagctggatagtatctgcctatctttattctaaataattacttataaatctagctttatatactcacatgcaagaacttaaatttttacttattatatttcattttcttaaacatcccataactcctgccttttaaaatgtttgtgaaccctgattctgtcatctcattctcctttcaagcatattcttctacaaaaaggaagagaaaagtctcttctaaccaaacagtatttacatctatgtcagatggatgattgctacccatttattgtatgtattgcattctaaacagcttaaagaattaaagcattacatggtacttatatttacctctctgtcctcaaataacatcccatattaaagctacttttcctatgttacacctgcacaatgtggaatacaagctctttttcctctcttctcctcaatctacatttacagaagactgaattcatagggcaggtagtcaaattgctagtgtataatttaaataacagaaccaatttcgtaagaacattaaagttagaaattctaactgaatgcttctctttttcaagccacaaaatttatttactacagtactttagtcttctaaaaaaatcaggtacatctaacaaaaaccttagtacaggcatgccctactgagattgtggcatattttctgaataatgatataaaaaaattcactcctaaaacagggcatcttaaaaaggagctaaggtcggctgggtgtggtggctcacatctgtaatcgcagcactttgggaggccaaggcagggggatcacctgaggtcaggagttcgagaccagcctgaccaacatggtgaaaccctgtctctactaaaaatacaaaattagccaggtgtggtggcacatgcctgtaatcccagctacttgggaggctgaggcaggaggactgcttgaatctgggaggcagaggctgcagtgagccaagattgcgccactgcactccagcctgggcaacaagagtgaaactccgtctaaaaaaaaaaaaaaacaggagctaaggtcaaaacaatacaattttgctttaattctttaagctgtttagatgtctctgatctagccaataaaaatattgttcatataatcaggaatagattgttaaccatagaatgcctctgaaaaacaattttctttgaaatgctgtcactaaaattaactgcaactttatttatatgactgtctgtggttttcgtgtatgcctaaaaagcacaagagaaagataaaaatatcccagaattggaaaagtagtcattatgtttggtttagcttactttcatatttttatttttaaaatccatccgaattaaagtttaccatttttcaatagaaaaatagaaggcaatttctttatgtaaaaatggaaaaagaaattcagcatcctctaaattaaatttggaatttgattagtgaatgaatgcctaaaatccttttccaccagttgtaaggctgaacacatatctatttttcatttagaacttacatacatcaattatgtgttccctgggaaggagaagtggcaacagaaaataatttgaatataatattatattgtgagcccatgtgtgttctcagataaaataaataataaagttggtccctattcaataacacagccttctcttaacatttctcaaccttagttcttccaaatcacagaattctacatttacactaaaagactaaccatttacactaaaatgctaaccacagctaaaagtgtcactcctagaaatctctcagatcttggctgacactaagagtcaaaagatcagggtttgaatcctagctctgctgtatccttgctgttagatctcagtaaagttatttaaatttcctaagcctctgtttacttatttgtgaattaatatactaccaccattatgtacgtgagttcatcacaatctattaatcctatacaactgctacatattaacatgaatgttacatgctaatgttgttccaccattatggaaggggtaagaatttttcccataaatcatcagaaaagggtcacgactacactggaaacaacaaaccacttaaggattaagccagatcaccttcaattagactaaaattttattatatctatctttggtcttgaagccgcagggttactcaagatcacataaggcatcacaattattcaagctattgttgttcatatacagaatattcacactctctaaagatatgcaaaaataaggcaataaagactggacaataaaaaattaatagtgatttattctgtttttaaaatggactttgatagatgtaagataaatttattttgtacttgacaacaccatagacattaaagaattgaaattgcgatccattatggaaaaaggaaaaggaaaaagaaaatttctgacgtaatccaacagattactctttaaatattaatctagcccaacaaatcttgaaatgctatgctaagaatatgccaagaagtcatctaggaaaatcttagggaggaaaagttctgtctaactcttagcacctccatttcactattctaacagcacatgactccacttattggagaaacatttatagcacttgaacatggcagtgtctgtcatacaaagagaaaatatctatttactaagtagtaaaatcagtatgtttctctcccttgctactggagaaataagagaggtatcataggtatctattctcttggttttcaaaacaacactatcctttctctgtcctagctaaatagctatgccaatccatgatttcccttctccctctatgatgtctgttggttcctgaaacttatgaaggtgagtcactgctcatactgttaaattggtatagtttatatctctccacactttgatgtgaatggaggtaggaacccacaataagttctaacaggtccctagcaccaaaaatttcccctcaatcacactaaaagggacattgaaacagggtttaaaagcttttatagaacaaatgcctgcttattcacactgtaaggccaattactggtatttgcaggcatatggggaaaaagagaaaggaatgcaaagggctttccaaaaagccattttccttggatcctcacattccttccccatttttaatgccaaaattcaagatttaccccctctgtaggcctacagaaccctcagctttctttacatggctgagttataacaatcaaaactaagcacctagcaatgtatctttaattttcagtgaagcaaaactggacagttattagctacgacgagaaaatttacaattttcaatacaaaatatctaacagatatttctgatccatgccaacaagagaatgaacaattgttcctgtgggtaaggtgctgagatatgttgaacaaacagcaacaatactaattaaacaatgggacaactcatttatggaagacattgttctaatcattttatgtgtattttttccactttatctttacaacaacctatgagattaatataatcattatcctcattttatagataagtattctgctggctcaaagtagttgagcaacttgtcaaaagtcataccacgcagctgagattttaacctaggcactctgctccagagcctgcactcttaagtatcatgttataccaaatgtcctctcaacaggactgctttgaagacactgcttctatgtgtttatgtgtgtgcatatccataaacacaatataaataagtacacacacacacccccagtaaatctggagaaccaaacttcgtagacatattacaaagtactttagtaatcacctttctagtccctcagtttaccaccatggatccaccaccagatagaatatcttgggtagcataaattatgttcaaccaataaattcctttaaaacgggtaacaacaacaacaaaaggagttgaactgcactattataaaataaccttcagaccttgtagctaaaaacaaaagaaatctaatttgtgattttaagatcaaattcaagccatgactggtcaacattaaatgaacttttggttttttatttatctgtgttttttgttttgtttttactaagacaataacctggacattttcaggaaaaaaaaaatatatatatgtgtatccctgaagttactaggctaagacttttactaaagaagcagtggaatttttctgcttttgagtatatgaaaatcatcaatttcatctttttttttttttttttttttgagagggagtcttgctctgtcgcccaggctagagcgcagtggcacgatcttggctcactgcaagctccgcctcccgggttcatgccattctcctgcctcagcctcctgagtagctgggactacagacgcccgccaccacgcccggctaatttttgtatttttagtagagacagcgtttcaccgtgttaccaggatggtatcaatctccttacctcgtaatccgcccgccttggcctcccaaagtgctgggattacaggcatgagccaccgcgcctggccctcaatttcagctttaatattagaaatttaaatgagaaaaagaagagcaaaataggcattctagaattaatatattcaaagatgaccgtacttgagggactaggagggaagataactatttctagtactgtaatatcttacaattaaattatcaaattatttaacagcaaatgtaacataaatgtaaaaatcaatgtgacaaaaaagaaaagtaacattataaatatgcaataatacaacaaccacttaccaactcaattccctgtggaaaaggtgtatcatcccagtccttctgtggaaatctctggattattttccccagaccttctcctgatcctgttaataaaatcaaagtgaatcattattataggacactaaaaactacaaatactcattctactcttacttatttctaaatgaatatttggtaaataagttaataaactgattaaacattttcaagttttaaaaaacatgtgagtatgcatcatctaaacattatgcagtaggacctccatatccatgggttttgcatctgcaggagacacccaaccatgaattgaaaatatttgggatgaaaaaaacaataaaattaacaatgcaacaatttaaaaatgcaaatcttaaaaatacagtataacaaatatttccataccattttcattgtattaggtattataagtaattaagaaattatttagagtatataggaaaatatgcataggttatatgcaaatactacaccattttatataaggaacttgagcatccatggattttagtatccgtgagggttctggaacaaatcccctgcaaatacccagggatgactatacagaaataacaggcaatctctattctataaacacttttttttgaggcagagtcttgctctgttgtctaggctggagtgcagttgtatgatcttggttcactgaaacctccgcttcccgagttcaagcgattctcctggctcagcctcccgagtagctgggattacaggcacccaccaccatgcccaggtaatttttgtacttttagtagagatggggtttcactatgttggccagactggtcttgaactcctgacctcaagtggtccacctgccctggcctcccaaagtgctgggattacaggtgtgagccactgcacctggccattattctgtaagactgactgatacgtatgaaaagctaaaaaacactagccagaggcattgaaatctagtctctaccacgttatgggagtaactgccctttgtgccccaataaggaaattaatcccaaattgaaatttaagaagaacttttctatggagatgaaataatttcaagtaacaaatgaaatggcactgctagcactaagtttcagttatgggctataaatactgttactggttaaagtttctgaggctggcctgggaacttgaccattgtttaggcagggtttcccaacatcagcactactgacatttgcagatggatacttctttgggggaatggggattgtcctgtgcattgtaggatgtttagcagtattcctagtctcaattcctagattccagtagcaccctctaccaccagcaagatgttacaatgaaaaatgtccccagatgttgacaaacgttccctgggttgaagaccacagatctctatcactgttgttataaaattatcctgtgacaccgaagaaggaatcaacttcccattgaactttggggatgtaatttgtgagtaaactggggatggaaggtacatgttaaatctaaactaattcttgctatagttttttaagatcttcatgttccttgcatattctacatgttgtcctagttcatatgaaatgaaggcaacaatattctgattatttgttttgtatacctaacttgaggaagtcttcacaacgaattcattttgttaatatactgtaaaaatcatccactatgatttctcaacctcatctctatgaatgcaacttctcccttgcccctcacctaaactgcaatcaatttacggccaaatttttatgtttaaaatataaatggaaagtgacattcactttactgaccaactcagaactgtattctgaaacgaggtcaaaccaaaatccatttgaaaaagacaaaataaaaatattctcaattaaaatgaataattgctgcagtacagtaacttatctatctcttgttataggggaatgaaggattttgttaagagtaaaccaactttttatcataggcactcattcttcaaaatccacctcaagcatcatcacttacgacatcccaagcagggttaatgaaacaaattgctaggtgttggaggtacacaaatgaaaaagacatagtccctatcctaaaggaactcataatcaattcggggaaacaaacaaatgaactgataatttcagttatgttatcgtaagctcaatgatagaaagaccatacaaaactttctggaagaaatgacagcaagcttacttcctttcagtaaccaacttgtttccccaagcacctggcatactgaattcctggcatatagtctatactgagtaaaatgtttactttaataaattcattggtactgactgaaattgttttaagtttattcctcccttctttttaaagagataaattaatgtacttattctatcatgtttaatcacatccctacattgttttttcagttctgaaagccatactaatgtattttacgttcaagaaatatttatcatattaattattttttggacagggtctcactctgttgcccagactggagttcagtggcacaatcatcgctcaccgcagccttgacctcccagactcaagcgatcctcctacctcagcctccaagtagctgggactgcaggtgcagaccaccacaaccagctaattttcatattttttgtagagaccgggtttcgccacattgcccaagttggtcttgaacttctggactcaagcaatccacccgcctcagcctcccaaagtgctaggattatagcgtaagccaccgtacccagcccaatcatattatcttttactaattataaaagtaatgttaagtgcagaaaggattttaaatacataaaaatataaagaagaaagcacccataatcccacacctggagacaattattattaacattttggactatccatttattcctaggtttcttgcataaatatatatatatatatatatatatatatattttttttttcctacaaaatgaataccacactgaacctaactttatacactggcttattacttaatattttacaaagggccttaaatgttgttgaacatacattttctagtttctcactattataaataatactacaataaacgtctttatttacaaatctttaacctcatctcacttctcctgaaaaaatactcttttccagattctacctctagtaaactgtggcagcactgtagcatctgtcagcaaatgtctgaggcattctgacaacatttcttccttttactgaagctagaattggtgtgtatcccttataagaaaagaacctaaatgggaccacactactctaagaggcactttgatagatagattgagttctttcaaactggtagaggatctggaaacaattacagtcatacttgggagatactgcaggtttggttccagcccacagcaataaagtgaatattgcaataatgtgagtcacacaaattttttggtttctcagtgcatgtaaaagttatgtttacactatactgtagtctattaagtgtgcaacagcgttacgcctaaaagatgtacatgctttaatttaaaaatgctttattgctaaaaaatgctatcaatcatctgaggctttagcaagttgtaatctttttgctggtagaatgtcttgcttcgatgctgatggctgctaactgatcagggtggtggctgcggcaattattgaaaacgagacaacagtgaagtttgccatatcgattgacactttctttcacaaaaaatttatccatagcatgcaatgctgtttgatgttattttacccacagcacaacttctctcaaaaattgaaatcattcctctcaaaccctgctgctgctttatcaactaaattgatgtaatatcctaaatcctttgtcatttcaatgaaattcacagcatcttctccagaagtagattccatttcaagaaaccattttctttgtttatccataagaagcaaagcttcatctgttaaaggttttatcgtgagattgtagcaattcagtcacatcttcaggctccacttctaacactagttattttgctatttccaccacatctacagttcctttccccactaaagtcttgaacccctcaaggtcatccataagggttggaatcaacttcttctaagctcccggttaataggttcatatttttacctcctcccatgaattatgaagttataatggcatctagaatggtgaatcatttccacaaggctttcaatttactttgcccagattcaatcagaggaatcactacctatggcagctacaggcttatggaatgtatttcttaaatagtaaaacttgaaagtcaaaatgactcttgatccatgggctgcagaatagatgttgtgttagcaggcatgaaaacaacattaatctccttatacatgtccatcagagctcttatgttaccaggtgcactgtcaatgagcagtaatattttgagaggaatatttttatgagcagtagttctcaacagtgggcttaaaatattcagtaaaccatgctataaatagatgtgctgtcatccaggcattgttgtcccatttacagagcacagacagagtagatttagcataattcttaaaggcactggaattttcagaatggtaaatgagaaacagctttaatttgaaatcaccagcaacattagctgctaaaaagacagtaagcctgttctttgaagccaagcatttacttctgctctccagctatgaaaatcctagatggcatcttcttccaatacagcctgtttcgtctacactgttactgtagtgtggctgccctcatcatcttagctagatcttctgcataacttgcagcagcttctacataagcacttgctgcttcaccttgcactttcatgttatagagacagcttcttttcttaaacctcatgaaccaacctccagcttcaaacttcttttgcaactttctcagcctacacagatttgaagagagttagggccttgtgctgaggattaggctttgtcttaagaaaatgttgtggctaatttcatctatccaaaccactcagactccatatcagtaataatgctgtctcattttcttattatctgcattcacaacttggctgtttggtacaagaggcccagcttttgacttatcttggcctttgacatgtcttccttactaaacataatcatttctagattttgatttgaagtgagagacatgcaattcttcctttcacttgaccacttaaaggccattgtaaagtcatcaactaacccaatttcaatactggcgtgcctcaaggaatagagaggcctgaggagagggagagagatgatggaatggctggtcagtggtgcagtcagaatacataaatcatttatggattaaatttgccacctttcatgggtgtagtctgtggcatgccaaaacaaaacagtaatatcaaagatcactgatcacatatcaccaaaatacatataatggaaaagcttgaaaacttgtgagattaccaaaatgcgacacagagacacaaaatgagcccaagctgttggcaaaatggagctgacagacttgttcaacattgggttgccacaaatcttcaatttgttaaaacaaacaaacaaacccacccataatatctgtaaggcacaataaacaaataataaataataagcaaagaacaataaaccaaagtatgtctgtctataaaaaggagatttagtcagaaaatttgaagcaaaaagtaaagccaggtgcactggctcacacctgtaatcccagggatttaggaggcccaggagtgaggaggccagaagtttgagaccagcctgggcaacatatggagaccccatctctacaaaaattagctgggaatggtggtacaaacctgtagtcccagctactcaagactcaactggaacccttgtgcatgttgatggcaatgtcaaatggtgtacctactatggaaaatatggaatatggaggtatggagtatgaaggcttctcaaaaaattaaaaatagaactatcatatgttccaacaatcccacttctgggtatatttccaaaggaattaaaagcaggatgttggtcaggcataggggcatgctattgtaatcccagcaatttgggaggctaaggcaggaagactgcttgagctgaaaaattaacatttatctgcgttttgattgtgacctatcatgggaggttttatatacatatgaaacagggttaagaatatggactcaggatccaggttacctatactctagtccagttccaccattccatcctgggaaaattacattacttctctgtgcttcattttcccccatataaaaaatgaagatactattacctaactcttagagctcttgtgaggaagaatttaagttaatgtgcatgtaaaatatataccagtatgagtaggtgcatgtttctcagaacagcactccaacctgaacataatagttgagattactgagccggtctgaataacatagtgtagagaagaaaactattattgttctagacaattatgttattaacaatgaagaatggtgttatttaaggtctcttggtggccacaagactcttgatttactggagttacttttgaatgaaacatgtaaatccctttttaaaacatgtttaatgctgttctgtacctgtacaaaagatttttcagactcaagttttatccctgttaaatttctttagtcagctcagtacatgcattttttggatcctatgtcagttacccagtgtatttatatccattttttatttaattaacttactttttttagttacagatatatactacaaaatgcaaccattttaaattaacagtctgatatatattgacaaactctcaataaaaacaattgcagtagaataaaaacaaaaatggagaacatggaaattaattatgttatattaaaatattgcttaaggagttcctccagaaaatatttcccgaaaaaaaattcatcaatattggcataagtccaattataatttcccgataataatcaaaatttcctgaggataaaagtcttggtcaaaacatgctatatacacattactgacactggcaccagtgcttctattccattctctcccaaaacaatctgcttggaacttcagcattgtacctagcacctgttcttctctcttcttcattaagaatatcatctcagaagaaatggctaaagcaaacgcacagcactagaaaatcagacttttgggtacatgtattgatttactcattttaatagaatagaagctgatctaaagatatctgtccaaagacagaactaagatgaaggccatattcaacttgcaagttccaagtatcccatttgtgatttggaaaatctgcttttgagcaaatgatttttttaaaatgttattttcatgttctctagaagacctgtgttataatgccaagacagccagaaaatcaaagttcaccagaataagtagatctaattgtgccagtatagaccaactttcaaaagataaggaaaataaaagctgctcattcactgaaaagaaagcatgcaggaaatcattctacaaaaggctttcatatttgatccatttagcatttaatgagagaagtctgtttgtttcaactgacataagccttttttgtggttatttaaaaatttaggtaggaatgtaatgtgattttctgattttccagtacaatctcctattattcaaaaggtttatttggaacatacaagctatttttcccagagttaaacttaggaaagagtccataggcttttacagaagtgaaaaagaatgcatttttactgactcacgcctgtaatcccagcactttgggaggccaaggcgggcagatcacttgaggtcaggagttcgagaccagcctggccaacatggtgaaaccccatctctactaaaaatacaatcactgggtgacagaacgagacttcatctcaaataaaaaaatgcatttttaagttgaagagaatacataacgaacaaggtatgtcattaaaaataataaataaacagcagctacacagctttaatccttataaactcacagttcactgagaatgtataaatccagcaatttagagaatgtcaagattaagaaaaactgagaaatgaatacaaactgaaattaaaactaaacatatgatctagcactttcatgaaattcttcagaatgcatcattttactgaattaaaatgtcttctttaacagcaatgaagaaagaatgattggcagtctggaatgctgtgaaaactatatggttgtacatcaacatttaagaaaagaaagtcttatcaagtcccttctccaaatatgcattgaatgtgttcccacccccagcatcattcacaatcactctagtagttcaaactctcatcatcttcatctgggtaacagcagcagcctcatcatctccctgcttcctgtttcacttcactccgagtcatgttcaagtttccggcagtctagaaataagctctgcaaaatcaaagttcttcacactaatttctctgatcaaaataattcagtaattctcccactagctatataataaaatagtccaaaactggccgagcgagggggctcaggcctgtaatcccagcactttgggaggccgaggcgggtggatcacgaggtcaggagatcgagaccatcctagctaacacggtgaaatcccgtctctactaaaaataacaaaaaaaattagctgggcgtggtggcgggtgcctgcagtcccagctactccggagtctgaggcaggagaatggcgtgaacccgggaggcggagcttgcagtgagctgagattgcgccactgcactccagcctgggtgacagagcgagactccgtctcaaaaaaacaaaaggtccaaaaatcattaccttagggacttctacctcatccaaggtgaagtaacaaggtctgaatttaccctccaacctacaacaactaaaaaaacaaaatctacaaaacaatggttttcagacacctgacatcaggcaatagaggacagtgaacccagagagaaagaaaacaaattatgtgagccctataattgccccagcttacttcttggtaagagtttccatgcaggatctagatgtttagctggggtgggggggtgagaggggggtgcagtttctagactgcagttcaatcaaggaaaatccagaagtcctggtaaaactgaagcaattgaggtgggaatctagggaacccaaagaggttagggttcacagagtatcaaagagaagagagattaacagggagaaagaagttcagagacctgcagaaggctgaatgaagcacacgaaaggaacagaaaggacaatccctagaaatcacacaaggccagggactgtttttgttcccaacagccaagaggaaaaaacgaaaaaacttgcataattcactaggcatcaggcagagaacccagagggtattattgcctcagtgtgaaaaattaaccctagataaaatgttgctgtagatctacctaacaaagctgggaaacgagcctcaaaaagatcaaactatttccaagtgacttaattacatctcagaacgaagttcaagaatatttacaggaacacagaaatatccagcaatcaagagagtaaaattcacaactctaacatgcaaacaaaaatcactaggcatgaaaagaagcagaaaagtatgggccacaaggaggacaaaaatcaatcaactgaaatagactccaaaatgatgtaggtattaattagtagataaagatattctaaattatcattatgttgcatattttcagtaatataaatgtaaaaaatatattggatatagctaatgaattagacactacaaggaaaaaaaggttaatggttgttatatgatagaaacttccaaaatgaaacagagaaacagactgggaaaaagacaaaaaaacaaaaacagagctgtgcaacaacttctagtggcctaatatgcatgtaacaggagtcaggagtcccagcatggaatggagggaatggagatatatctgaagtaataatggccaaatttaatgaaatttgacttttccaaatttgatgaaaactataaacacactgatcatagaagctcatcaaatcccaaacacgaagaacacacagaactcacaaaggcatatcataataaattacttagatataaagataaatatctaaaaacagctggagaaaaaagatacattgtgcagagtaacaaatataagaatgacagcagacttctcattataaacagtacaagctagaagacagtggagctacatctttaaaatactgaaagcaaaaaaaaaaaaaaaaatcaaccaaacgttttatacccagagaaaatatccttcaaaaaaaaagctgagtatatctatataatcgaatattatttgaacttaaaaaggaatgaaagctgggtgtggtgactcacgcctgtaatattacccagcactttgggaggccaaggcaggcagatcacgaggtcaagagatcgagaccatcctggccaacatggtgaaacctcgtctctactaaaaacacaaaaactagctgggtgtggtggcaggctcctgtagtcccagctactcaggaggctgaggcaggagaatggcgtggaggcaggagaatggcgtgaacccaggaggcggaggttgcagtgagccaagatcatgccactacactccagcctgggtgacagagcaacactccatctcaaaaaaaaaaaaaggaatggagtactgatacatgctacgtatcatggataatccttgaaaaccatatgctaattgaaagaaaccaaacgcaaaaggctacatattgtatgagtccatttatatgaaatgcccagaaaagtcaaattcaaagagacaggaagtaaattcatggttgacaagggcttaagggggtaaagggagtgattgctaacggatatagggtttctttggggtgatgaaacattttaagtaaatagtggtgatgtcgcatgttcccacttgtatgtggaagctgaacaatgacaacacatggacatagggaggggaacaatacacaccgcggcctgttggggggaggtgggaggggggaggcagagtatcagggtaaaatagctaatgcttgtggggtttaatatgtaggtgacgggatgataggtgcagcaaaccaccacggcacatgtttacctatttaacaaacctacacgtcctgcacatgtatcccagaacttaaaataaaattgagtttaaaataaataaacaaataaataaatagtggtaatggtcgcacaactctttgaatatactaaaaccactgcattttacattttaaaaggatgaactttacggtatgtaaattatatgtcaataaaggattttctttaatgaatctctgatcagacacaatggtatagactcattttttcttgctcttccccactaagtataagcctataaataacacaggaggcaaccaaaggagaactctgaaaggtggtaagaggaaagtaaactgttttgtaaccctcggaatggaggaacaacacaatggcaggacatcttacctatctctaccaaacagaagaaggcaacccaggcctagcatgtcccaatccccaggttaacaacagaaggcagccaaggtaggctcactcatctcccagatcaaacagaagttccactaacaacacagggaaagcccagaaccatgagcaggggatagacagccacagtgataataagcagccagggaaagcactttccttcactcctggccctgactccctttccccaaaggcagataccatgtgagtaggcatcaccagcaagagagaccccatcacaataagcaggatggcctgggaagcctttgtcatcacaggcctaaggctctcctacacaaccaagagaaactgaggtgtccagctagcaccagcaagaggtatctcgctgtatcaagtaacctcggcagacattttgtttctatgggcttaagaattccctccccaatccagaaacactggggtagtcagaggacaccagtaagagagactccactgtaacaagcagtctggcccaggtagtctctttgtcctcatgagtcagaatctctcatgtactccccagtgacatcagggcagtgaaatagcaccaataatgaacatcgtgccacacaaagtagcctggtccagcaaaacctctttgtccctgtagcctgagagtcccctcccccaccaagagacatcaaacagctcagcctggggaatgatttctgccacctcaggcagcaccagtgggagctctagtgctgcctgaggtgacagaagggctatatttaatggccccagcattaaataaacaaagaaaaccaaataaccaagaaaatcaaaataacactgaaaaggctctgaaaattaaactgccactggaacaacagcctacaaaattagactatggtctacatgctaactctaaacacaaaaactaacataacagccaaaatgtccaggatatagtaaaaaagcacccattacaccaagaaccagaaaagatcacaacttgaatgacaaaaagacaattaactgatgccaacacagacatgaatcagatggaagaattatctgcaaagattttaaagcagctaccttaaaaatacatcaaatcataaactctcttgaaacaaatgaaaaatagaaatatcagcacagaaatacgttataaatcaaacagaaattataaaactaaaaaataaaatatccaaaattaaaatctcactggatggtttcaatagtagagtgaaaatggcatagcatagaatcagtgaacttgaggtgaaatcagtagaatttacccagtctgaacaacggagagaaaacaaattaaaatataaagaacattgggaacccatgggaggtccacagaccataacaaaagatccactattcatatcactggagtcccagaaaagaggagaggaagaggggaactaaaagaatattcaaagaaataatggctaaaacactcccaaatttggtgaagcaccaaacatattcaagaagttgcgtgactctcatactggataaactcaaaagaaatctacactaagatacatcataattaaacatctgaaaattaaaaacaaagaagtcttgaaagaagccagagagaaacattttacctacaggataacaccaattcaaatgacagcaaatttctcatcagaaaccatgaaggacagaagaaagcagcacaacatttttcaagtgctgaaagaaagaactatcaactatgaattctatttcccacgaaactacccttaaggaatgagaggaaaatccagacattcttggaccaaaaaaaacaaagcaaaaaaaactacactaacattgaagattggctgaaggaaggtgtttaaacagaaaggaaattacaaaagaagcaataccggagcatcagtggcaaaacaaaaatacaaatccaagtcatcctcaatctagtacttaaatacttctccagtccaatagctggtgttctgatatcagctggctctaaacctcttcccagggcaatattcttcatgcttattccaacaacctttaagattgcttaaaacttctctgtccttgaagcttactgcttgcctgatttgcaacctttagttgccagggtagggtgaggagggaccagaaggcactgtcagaattgattcttttttcaacacaaaacttaatctgagtatgaccctaacagataagtttagtcctagggccctctctcctaatacttccttttctatgggaaaaaaaaactagatcatacaagggcaagcccaaaggcacaataattaatattttttctcactgtaacaaatggaaaacaagctcaaccctctctcacaagcacttatttaactacttaaagaaaactactatgtcttatcaaaggtaaatatgatatccatttcccttaacttctgagtacaagggcctattaaaacaccagtacattaaagctatcaacagtaattatgaatacacagaaatcatctaaaatataaataccttcccatggttgataaactaatctaagaaagtcctcaagaaaaacactgccatgttttgaaaagaatactacattggtaatcaggagatctgaggcttatcttagctctgtcactaactggtgaccttaagcaaatcctctaacttctctaagccttggtctcccacctgtaaagtgatcttaggtccctcctggctctaaacttcaggcacggtaaaccaacaaaaaatgtgaaatacatacatctaccactagatggcataacactatgattgctgatctgaaaagcagaccaaaatctcctccagatagattatgttgttaggaaaactataccagtttaaattataccaatttaaactaagcctcaataacttgtctgctggcaaagaactcccggctacttcataaacaccttcattttgtatgatgtagaatgagaaacctctttctgaacttgttacagttatcatgaaccaaactgaaaatttacaaagacatgattacagaattctgagaaactaagtttacagcaaaggagggggtgaaggaggcggtgaagacgtgtggcaggaaagaacacaggtggagggacagaatggagaaaaaaaaagaagctgttttttggcaatttctgcagtattatctatgcctatcaaggtattacgaaaattattaccactataccacagaatatttagcctcccttgataattcagcagagaaaacactgccacattaaaatttcagacaaatttcttggaaccagctttaaaaacattaatatattggtagtatctataaaacattgatcctttcagaaaaaaaatacaactgaaaatttaaaacacaattctctatgacttaactgtaccactttcactatgtttaagttatatttacgttttcttccaattgcagataagactagtacatagcaagtgcttagtttcagcatagattttttaaatacaacatttttaaactagggaggaaagttattgattaaaaaacagcaaaggctattatgttaatcttccttaaacaagaaattcgtatctgttgcataatgcaactggacatgatacacataaatttctcattaaaactcattcaatgtgtccctatcaatgtattccctaaccctaagtcaataaaggagaagttacaaaaatccttagttctccagcaacctgtgccttcaaaatcaagtaggcctttctcattacacaaatacaggtgacaaatttcttcttcccaaatacagtttaaacatgtcccctgcctacaatgctctcctctccacaaatttgtttttttttttttcccatctctaacttcctatctgcaactcaaagttcaccctggagcatcgcatctacagcacagataatccaagccgtgtgttttctgctcaactcttctctcaaacgcaaacttcctatcctgcaaaaagcattacagattgtttatctgtccaaacaagttatgaggctggttataatatactttactaccagctgttttccttaacgtttcactctcctgaagacaatcatttccttcttgtaacagatagagtatttctcaagctcccaatgctgtttgtaccccctattaagcatttccataaacacagcaaattaatcatgaccaaattgggattttctattatttctataaaatctgtatcttctctccctccattctctatctcagagaatggcacgttatccatctaagcattcagtgtctccactaggattatgttccactgcatatgacagaaaacctaaaacattaatagcttaaacaagataaaagtatatttcctttcatataaaagatgtctcgaagacaacactcaggatcaatgtcagatctatgggctcaaagatccagcttcttcaggttcatcactccactatctacaggtttagacccttgttctcatggtttaatatgtctgctagagctgcaaacatcacatccatgtttcaagtagaaatcaagaaggaaggaaggaagctgggcacagtggctcatgcctgtaatcccaagcactttgggaggctgaggcaggaggatcacttgagcccaggagttccagttcagcccgggcaacatggcaaaactccatctctacaaaaagaacacaaaaattagctgagtgtggtgttgcacacctgtggtcccagctacacaggaggctgaggtggcagaattgcttgagcctacaaggtcaaggctgcagtgagccaagattgctccactgcactccagcctgggaaacagagcaagaccccatgctcccttgcacaaagaaaaaaagaaaagaaagaagaagagaagaggaagaaaggaggaggagggagaggaggaggaggaagagaaggaggaaggtatagaatattttaaggagaatttctggaagaacaatttcacttacatatcacttgccaaagccttgtcacatgattacacccaatagcaagggagtctcttagtctcttagacaattgccctgctaaaacacaagagttttatttctaaaggagaaaaaaatagtattaggagacaactggccgtttctaccagagtcagctcttagtctgacaggtgccaacacatcatgtagaaccatctgttaaccaagaacacagcagactccccaggaataaaaccatgggtgtggggttgtgaaaggaatcacagtatggaaagggcctcttgtggccaggcgcggtggctcacacctgtaatcccagcactttgggaggccgagggaggtggatcacctgagatcaggagttagagaccagcctggccaacgtggtgaaaccccgtctctgctgaaagtacaaaaattagctggatgtggtggcaagtgcctgtaaacccagctacttgggaggctaaggcaggagaatcgtttgaacccaggaggcggaggtttcagtgagctgaaattgcgccactgcactccagcctgggcgacaagagcaagactcttgactcaaaaaaaaaaaaaaaaaaaaagagcctcttgcttgctcaatgtacatgtgttttcagtacttccattttgcccaatcccaggtatactgcttttatttgacaatgtaacactgctatgcatgctcatgtcactggtatccagtatttagaaatttgttctctatcacatctaacaacaaagccagtagccttctcagagaagatacagttagctctaaaatgaaggaggcttcactgtgattctcctgtcagagcctgccacaaattccacatagcaaccaaatggcagtttttatagattgttgagtcaagaggttggaacagtacacttaaaatttagtatatcctgacttcaaacccagagagacccaccagttactgtacttctttttggtagcagtgaatacaagatgcagtagcttatcttctacttcagaaaggacatcccaatatatcccaaaatactgttacctcagaaatttcactaaggtgtcaggtcctccaattttttatggacttcatgtcccatcatcagctgtgtctttagtgtctttacaaaggatctaaggtgtctgctagttctctatcacaatgtcctatcaattagcatgatgtcatcactgtaggggaccaggataacgtactgtgggatagtgagatgaacaaaatccctacagactaaatgatggcacagagccaaaatactgacctaaccatggaggcaatatgatgacggtgtactatactgctgggtatttctgatgttctcggttaattagattcagtaaggcatttgatagatcaaatagttaactaccaagtgcctgtttctagcaaagttctgtttctagcaagtgcctgtttctaccaagttctgtttctagcaaagagaccacatgtggaaccaaatatacaactggagtggtagaagcagcttatgataatacaccatcattctccaaaatgtatctatcttctgcataggtaaaaccagagttagcaggctgaacctttcaagtctttaatatggcactaatctctgagattcaggatgtgagactgctttggtaaaaagaactttgggaggttacacttggctcttcctaccataaagtccattaacccatggatatgggaactaatttggggattcttccacttgttgaacatatttattccagacatgcagtaagaaacaagatacaaccacggtacgaattcatggactgtgaaataatttcaagtcaaagctccattccatgcctgatttccacaagctcccatctgcctcatggaacacaacggtgtcctgagtcgctgggaattatcattagctcagcttccaataactcctgaaaggtttcagtatttgtcttctgatgaacagttaggcttgtaaataataaaagacccctttctttagggaaggctatgaagaaaattaattgtgcctacttgtgatattatcacaaggtccttccttaaaggaagatatgctgcctcttttttcttcaaggagttctagatttgtaaagtgataaatctataggtattagacattatggagacctaaaatcaatcctacattcattggaccttaagtgttctcttttcatttgtttgtttagttccagtatcaagatcaagaccttagtgagctacccttccatgacagttctaggaaccccttaatcaatttgcatactatattaagcatgcctatcttgagtctgatggttaagttctgttactcgcggcagggcgcgctggctcacgcctgtaaccccagcactttgggatgccgaggcaggcagatcacgaggtcaagagatcaagaccatcctggctaacatggggaaccccgtctctactaaaaatacaaaaattagctgggcatggtggtgcacgcctgtagtcccagctattcaggaggctgaagcaggagaatcgcttgaacccgggaggcggaggttgcagtgagctaagatctcaccactgcacttcagtttggcgacagagcaagactctgtctcaaaaaaaaaaaaaagttctgttacttgcctctgccattccaggattccactaaattcagaaagctcattttgtagcagcatctcttacattcataccaaggccagagaagacagccagtacagtactttttaaggatgccagcatttctctcactgttgtattttcttaaaggtagtagagaacacccatcttggaggatgtttttagagagtaaggaagccagctgcacaaaataaatccaccccaactttcctaactccccaagtttggcatctcaactttactcaatggaggtcactactgaatccacatttcagtcaaacaagcagacaatcagaaccactcctagctgcttcagcaagaaccaaatctaaaatctctcatagatgaatctacattaatagattcagcccaaactaaaattagattcctcctttcctggtccagcacctctctgaatttgatttcatatcaattgcataggtttttgctaacataaactagtaaaattcttgcaattcttttgatgcacaaaacttgtctttcatcatgaagttagccccttgaacttcctgggatctgactctcgctattggtctagaggccaaaaggtggtgggaatgggaataaaaacagctatcactcaacaagctgaagtcattacagcatctttaagcatcactcaaaggaagaagggttacttctgctggcaagggaggctcagtacaaaccacaggttaagaatacctggagtcattcaaatggttccatgtcatgattccaattcctgaaatcttactctttcccaatcaataactcaacttacacctatgaaatctgatgaagctctgagttcactctgcactgaacacagtttaataacttgttggatcagactctgaacccgatttagactatgacagtcctagagttataagacaaaagactcttttaagccaatcaccaaattcctaagtgttctaaccataacttcagccaagatttaaaaatttagccctgcagtttaaattttctttaaaccagaatttctcaaactaaacactattgacattttgggccaggtaactctttgttgtggtggtggggaggggacaatcctgtgcagcagcattcttggtctctactcactagataccagtagcaccctgctcccccagttctgataactaaaaaatgtcaccagacatttctaaatacgccttggagagcaaaatcaccccaggttgagaaccactgctttaaactctacagtggagttaaaaacagccaattggccgggcgcggtggctcacgcctataatcccaacacttttggagtccgaggcgggcggatcacaaggtcaggagatccagaccatcctggctaacacggtgaaaccccatctctactaaaaatacaaaaaattagccaagcgtggtggcacgcgcctgtagtcccagctactcgggaggctaaggcaggataatcgcttgaacctaggaggcggaggttgcagtgagccaagatggcaccactgcactccagcctgggcgacagagaaagactctgtctaaaaaatacaaaaaacaaacaaacaaaaacagccagtcctctcatatctttactttcctaaatggatcatcaatcagtttagcaaagctttgccttcaacaggtacttcatcccaggtaaccacagatgaaaaacactagatgccacaaactggttaccagtgacccttctagattccctgaggatctgttgcccaaaacagttttacatctatttaatggtccaggatcagaatccactccaggtagtttaagcaaaaagggggcttaagataagaatcagatgctcacaaaatctttggaaaaagtagagaggcagggtccagagtgactgagctcctagaaacaactcctagcccacagaaccactctgcctcagccacaatcacaaaagctggtaccatcagtgtaggaagctggcaagcaaggaagctcctgtagaagctacagaattagaaacccactgctaaatgacaaggctgccccacaaactactagctcagagccattctacttttctcataatctaaacccatatccttcctctctccccaggtggttcacttccaaatcaaagtgcatctgaagggtggaacctaaatcatgtccagaaaacaaagcagcctatagggaaaaaaaaattttactagccaagaagactattaggcactctcattctgaaagctatgtttttcactgtcatcttaaaaattggtattctccaagagatgtaacctatcaattattgcattgttgcatttttaacctatcaataatgcagttccctgagcatgaattactagaatatagattccaaaccaaggttaatgtcatcttgtaggaacctctttgtgtaaccatctggacttccataaaggaaaatcctctgcatcaataacaaccaaggtgggaggatcgcttgagcccaggaggtcaaggctgctgtgagccgtgaccgtaccactgcactccagcctgggtgatagagcaagaccttggctcaaaaaaacaaacaaaaaaccatgtacctcttatgattctgaactgcaacattctcccacacttactacaatgaatccatatcatttcttgcatagactactgcaataccttcataactgctctccctgactttacttgttgtgcacttcaaatcattttccccaaagtaccagaatttatataacatgttactccacttaactgacttctcatcacattcaggataatgactgaatttccatctgacttaccaaatgctcatctatgtctttaagagtgctctagtttcaacaacctgtttacagctccccaagtaagtcaggtccattcaaactcatttatctgcttttaagtatactgtcccttctgtggacattctcctctttaatcttacctccatttctcccattaccaggttaacatttacacattttaaagtgtcatctctttttaggaatgtttcctgacaccttgttcccctaggctaagagtggtccttcccgatgcttccataatatcttactcaaaatccttaagggaggaaatgcaaacagttatgtaatcttctccagtaggacttaagtctaagacataaaagaaaaaaataaaaatgattataagagaaggctgagagattatttcattctgttgttgaaagatctaaatcatttagaaactttctttttccttacactgagtcaaaatctttttgaagtactctcaccaactgatgttacctagaataagaaaaaatgcgtctattccttctttaagatgatagcgatagcttctcagctgtttgaaagccataatcatgattctccattcctctctaatgtaactagttttcccatcttagactgctctaatccttaatagtgttcaactaaagtgaaacactttaaggaacgtagaagaattagttcagagtaagaacttctaaaaggattaaaaagtaaaaagagggctgggtgtggtggctcacgcctgtaatcccagcactgtgggaggccaaggcgggtggatcacttgaggtcaagagttcgagaccagcctggccaacatgatgaaaccctgtctctaataaaaatacaaaaactagccgggtgtggtggcgggcccctgtaatcccagctactcgtgaggctgaggcaggagaatcgcttgaaaccgggaggcggaggttgcagtgagccaagattgcaccactgtactctagcctaggtggcaaaaggagaatctgtctcaaaatagtaatttttaaaaaaaagtagaaagggataaaaagtggaactcatcttaagaaaatgcaaatatttaaatgatataaataaatgcctaaatgaatcttttaaaaaatcataaataatacaggagctaaaaatagaaagtataagtataccactttccttgcctttcatagtaggtaatcaatggacactatacatttgataattcaagaaatagaggtttaatgtaataaagtatcctctagactgacaatattaaatattaacatagcaaacagatatcaggaggtagaaggagaagataattattaaaaatacaaaattccccatccttcatattggagaactaatagatgctgtctaaagttgtccaatatattcattgctcataaagcatccaccaacagaacaaaaactgacagaaaagaggtcttattttgaggaagtaggactgagtgtgcaagattatttcttttttcttggaaaggagactttttactttatattcttctgtttaatgactattttgtttacaaaaaacaaaaacaaaacacacacactcaagtagcttaataaaacagttactaatgctatataacatggtagaaaataagtggcaaatctgtgattacatacttaagacaataaaaggcaaataacccctgacaactttacgtagtttcttctatttattagttctaaagtatcattgctataaaatcacaaaatgttcactgctacaagtcagagatgatgagatgcctctatcagaggccaaactgtgctgctacttcctcataatttttatgagagaaaaaactctaagccttagagaggtattactctattttataataatctgtgaaggaaaggataacctctgtactagtctgttctcaccctgctaataaaaacatgaccgagactggttaatttatttaaaaaaaagaagtttaatagactaacaattccacatggctggggaggcctcacaatcatggtggaaggcaaatgaggagcaaagtcacatctttttttcttctttgagatggagtctcgctctgtcgcccaggctggagtgcagtggcgcgatctcagctcactgcaacccccgcctcccaggttcaagcaattctcctgcctcaagcaaatctctagctgggattacagctgtgtaccactgcacccagttgatttttgtatttttagtagagacagggattcaccatattggccaggctagtctcgaactactgacctcaaatgatccacctgcctcggcctcccaaagtgctgagattacaggtgtgagccacagtgcccagccgcaaagtcacatcttacatgacagcaggcaagtgagtgtgtgcaggggaactcccctttataaaagcatcagatctcgacagacttatccactatcacatgaatagcacaggaaagacccacccccccccccacccaatgattcaattacctcccaccagatccctcccatgacacgtgggaattatgggagctaaaattcaagctaagatttgggtggggacacagccaaacaatacaattccaccccggcccctcccaaatctcatgtcctcacatttctcaaccaatcatgccttcccagcagtccaccaaagtcttaactcatttcagcattaactcaaaagtccacagtctgaagtctcatccaagacaagacaagtctgttccacctacgagcctgtaaaatcaaaagcaagttagttacttcccagatacaacggagggtctacagccataccaccctgaatgcacctgatctcatctagatacaacggaggtacaggcatttggttaatacaccattctaaatgtgagaaactggccaaaacgaaagggttacaggccccatgcaagtctgacatccaatagggcagtcattaaaccttaaatttccaaaatgatcccctttgactccatgtctcacatccaggccatgctgatgccagaggtgggctcccacagccctgtgcagcttgattcctgtggctttgcagggtatagccctgctcctggctgttttcatgggctgctattgagtgtctgtggcttttccaggtgcatagtgcaagctgtcagtggatctaccattctggggtctggaggatggtggccctcttctcgtagctccactaggcagtgttccagtggggactctgtgtggcggctctgactccacatttcccttgtgcactgccctaacagaggttctccatgaagactccacccctgtagcaaacttctgcctggacattcaggagtttccatacatcctctgaaatctaggtagaggttcaacaaacctcaattcttgacttttgtgtacccacaggctcaacaccatgtggaagctgccaaggcttgaggcttgcaccctctgaagccatggcctgagctgtaacttggccccttttagccatggctggagtggctggacgcagggcaccaagtccctagactgcacacagcaggggggccctgggcctggcccaggaaaccatttttcttctcctaggcctctggatctgtgatgggagggactgccttaaaggtctctgacatgccctggagacattttccccattgtcttggtgattaacatttggctcctcgttacttacgcaaatttctgcagccagcttgaatttctctccagaaaatagggttttcttttctattgcattgtcaggctgcaaaatttccaaacttctatgctctgctttttcttgaatgctctgccgcttagaaatgtcttccaccggataccctaaatcatctctttctggttcaaagttccacagacctctagggcacgggcaaaatgctgccagtctctttgcatagcaagagtgacctttactccagttcccaacaagtttctcatctccatctgagaccacctcagcctggacttcattgtccatatcactatcagcattttggtcaaagccattcaacaagtctctaggaagttccagattttctcacatcttcttgtcttcttctgagccctctaaactattccaacctctgcctattacccagttccaaagatgctcccacatttttaagtatctttacagagtgcccccctacctcagtatcaatttactgttttaatctgttctgatgctgctaataaagacacaccagagactgcgtaatttaaaaaggaaagaagtttaatggactcacagttccacatggctcaggaggcctcacaatcatggcgcaaggcaaaggagatgcaaaggaacatttacatggtggcaggcaagagagcttgtgtaggggtactgccctttctaaaaccatcagatctcataagacttattcactatcacgagaacagcatgggaaagacccaccctcgccccaccagcccatgattcaattatctcccaccgggaccctctgatgacacacgagaattatgagagctacaattcaagatgagatttaggtggggacacagccaaatgatacctccaatcgttctagattcttgttcattaacatttacagcacatacaacaaatctgttaccaagacctatagcttctattgctaaattctcatgtgagttcatccctcctttctaccaccactcccttaggccttcataatttcttgcctgacttggtatccctacctcctgtttcttaccctatacattgctaccaaaataatcattctaacatgcaaatttgaaatcatactcacatttaaaatgcaccaatggcttcccactatctatgatttaaagttcaaagttcttgacatgagattcaaggccttgaatcatctggctccagtttaacttctctggcctcatattttgacacttccccctttccccatatataccctatactgtggccccaccaaaactacttgcaattcttccaacctgtcattcattgttaggcccccacatacatatttgtgttcttctctcttcttcctagaaagccctttatttaattcctcacttggcacatcctatttctcatagataaaacacaggaatcacctcttctagaaagccttctttcatctcctctctttcctgtcagactgggctaagcttctattcctctgtgttcttcatagtatcctgtttatacctcttatcatggctcctttcacttatattactattttctatttacctatttgtcttccctactagactgttacttccttttttttttttttttaattgagactcgctctgttgcccaggctggagtacaatgccgcaatatcagctcattgcagcctctgtctcccgggttcaagtgattctcctgtctcagcctcccaagtagctgggattacaggcatgagccgtcacgcccagctaatttttgtatttttagtagagatagtgtttcaccatgttggccaggctagtctcaaactcctgaccttaagtgatctgcccgcctcagcctcctaaagtgctgggattacaggcatgagccactgtgcccagccaagactgttacttcctaagagctgtggcttttctcacaagtcaagcactttacaatagtgatattcaaaatgacaatttctcaactaatttatgcatcatacagctacaaagctagtatctacattagggggcacaatcatggagggaatttccccacacaaaaagtaacaagagagaattctgcttatgctatggctgagtaagcacctactagattaacgttcccacaggtaacaactataaattctgaacaaaatataaaaatcagctacctatatataaataggtatataccaaaatataaaaatcaggcactgaagagtgaccaaaagcagacaaatattagagggcagtcagtacttggaagagtatggtattaggtgaatttcccatctacaacttttggcctgagggcagatccagtcagcaccatagcaagtacctaaaactctaagataaaccccactgttttactatcttgaagaatcaaaggacagagttcaggaagaccacagttgctgaaaagtgagaaacacatcctaggaagaagagacccagaaaggtagagacacaaaatctagttacaaactctgtacaaatttctggctgacccctgaaccaaacacgcaaaggacagactgcaagcagtccaggtagagataaaagaactgaactaagaactactgctcaagagacagagcttgcagtttttgtcccatcatgttaactgcctgctaacaagcatcaacactctttggaggaatataatggaattcagaggctccacaacttcatattcacaatatccaaaacacaatctaaaattccttgactaacaaaaaaatcaggaaaaagtggccaagttgcaagacaaaaggaaaccaatagaaactaactccaggatgatccagatgttggaatcagcatagattttcaagcaactattatgattctgcttaatgatgcagagaaaaatacaacacaacaagtttgaaaaattaacaaagcaatagaaacctaaaaaataacaaagtagaaattctagatctgaaaaatacagtatctaaaataaaaacattcactgatggcttaacagcagaatgaagacgacagagaaaaaggtacacttgaaaacagatcaataaattaccgaatttgaagaactgagaaaaagcaaattggggggaaaaaggaacagagcctcatgactggtctgcacatacaatgctaaaagatttctgaaggttgctagatggaaactcaagtcttcagaaggaaagagagcatcggatatgtcttaaaatacactcattaattcaacaaatatttattaacccatttatattggaggttgcaaatttcttttgtgaaaaaatcagaccttggcgatgaccctgagcagcaggatataaataacttccacaagcttagcattccaataatggaacactaggcataaatggattaattacccaggacagataatgtcctttaggcaataaatgagtttcaataaccttatatatatatatcatttttattaatttatgctacatcttcagagacgttttatcggtagatctctatatttaggccatcagtctgtttacctctcaaactgtatttacaagttgtattcattttataaaaccaagaatacaaataaaaagtaactcagtagaaacaaattatttgttaagtaaatactttaacgcactcactgattacataaaatctaacaagctagaagtaccaacatcaattatgtttccctcctgtccgatattcaattccttaatgagtcctgtcatttttatcttctaaatatacagatgacccttgaacaacttgggagttaggaaccccaacccctagagccgtcaaaaatctgcacataacttttaactcttcaacaacttagctactgagagcctactgctgaccagaagccttaccaataaacaacacatattttgcacattatatatatatatatatatatatatatatatatatatatatatagtattcttacaataaagtaagctacagaaaagaaaacgttttaaaatcataagggagagaaaatgcatttatagtattgtactgtatttatcaatactgaaagtttatgtcatctgtttataaatgaatctctgtctgaaatggttggcaactaaagctgcagacttcaatctacactacatatcaagcaattaaactttttcttgtaatggcatgacttttgtctgtttctcaggaacacttccagcatcgctagtggcactgtgtatgagtcccatagtgttattcaactaaacatgatgaaaaataatcaagagtgagaatttttaactatcgtatccaacttactggagagataaactgttcacttggagatgactggcatcatatggtattttaaggtattttaagcagatactcgcaagacttgagctcaccacaatagcaacaggaggcagctacaaaattattaacaatactacagtatatacttcagtatattttatgcagttttaatactgtatctttacatttgtttacatttctcaactgaatggtgtcatgtatagtctacagtgtttgtggcgtaagttttcataaattttaactttttataatagatttgtgtatattttatggtaagatagactagtatctacttatattttatgtattcatgcaacacctttttcttaattttcccaatatttctaggctatgcagtttgtctgcaagttttttcaaattgtcacacatcaccaaataattttccaatatagttattgaaaaaagatccatgtataagtagacccatgttgtctaagctcatgttgttaaatggtcaactatattttgaatgcatacatttccctcaatctctattgcttttacactagatccagccaccatcacttcttattagtctccccactccccatccataattctcacaacagccaaaataaattagatcatgtcactttacttcatttgcttcccattgcacttttaataaaatctaagctccttactaagcttacaagatctgtatgatctggcccctacctccacaacgtcattcatccaattctagcctcaatgtcacccactatattccagccacagaagcatcctttcaattccttgaacataccaagttctttcatacctaaagtttttttaataggctgtcccctcaaactggtttactcccctttctgcatacatggctggttccttcgaattcttcacatgttagtttgtatgtcacctcttcagagtacctaccctgaccaccttgttgaaaatagattttccattatctaacactatattttccctttatagtacttgtcacaaattgcttaattatggtgttgttgttttgttttgcttttattgcctaagacccctacaggcctacagctccatgagaacagggaccacacctgcatgatttaccaggatgcccaatggctaatacaataagagtaagtgatggtgcttataaattttattaactgaaagctcaagataaactcaaattttcacacatttcaaatagtgtttcattttaaataggtttgccatcttggagatagaggggtatgaggagactaatttaacaaataaaagctcatagtgtatttttattaaaaataaagtgaacataaaaacattcccttcgttgtccctgataatctatgttacctcagaattaggatgaaaaacaactgaacttatataaattaagaaactcaacaaatcactggcaatcttccaaatgaactcatatcttaaaatataccaatttgagaatattattggtatttaactgtttcaacaaacaaaaataaaaacacttcttctttaaaaaaaaagacacaagtggaacatgaaattatgccagataaatgaaaaagatctttttaatagaggcagcattttgaaaacccaatttcctattaaaaaaaaaaacccgtcgtctaagtggtataacaatgttcttaagaaaatagtaaacatctaaatcctagacaagggctgtccctaaagactagtcatagaggttgtatttgtgctattataaatagaaatttatttcctaataagtgatccatttttgtgtcttgtattatctttacagaaattctagatgacacaccattttcaaaaagaaaaaagtgctgggttttttgccttcatttatttaattctatcaaaagcattcatccattctgtcatgaaagttcttaaaataacattttgtgcagtttacttctaactatctcacgggaaattattctgacttcttcccaagaacatttcatcattttagactcaaccatttgtaataaggttggcaaaagttaaattgactgacaatgcccacagctgatgagatcttttttaaaaagaaaaaagcactcatataccccacagtttgaaataaaatgtaaaggagtcgattagcagtatgtttttcaaagtcttaaaaaatattcatgccttttaaaccaggattttcattaccaaattttatccaacagaaataagcagccagaagacacatataagcctgtttactataaaactgaaaacactgaaaaaatttaaatgacctatgtgtcatttggatatttaacactggcaatttttaaaataaattatggcatattcatggtcacgacccggtcacaataaaggctattcatttttttaaaagacagtgtacagctactaaaagtagcatttatctttattagcatagaaagatgtcccaaaaaaccaagaaaataaacgagtcacaaaacagcattatactatgaagtaacatttaagaaacaaaacatgttttttgcatgtggtacacatgtatttttttcttaattttattattattatagtttaagttttagggtacatgtgcacaacgtgcaggtttgtaacatatgtatacatgtgccatgctggtgtgctgcacccatcaactcgtcatttagcattaggtgtatctcctaatactatccctcccccctccccaaccccacaacaggcccgggtgtgtgatgtacccctttctgtgtccatgtgttctcattgttcaattcccacctatgagtgagaacatgaggtgtttggttttttgtccttgtgatagtttgctgagaatgatggtttctagcttcatccatgtccctacaaaggacattaactcatcattttttatggctgcatagtattccatggtgtatatgtgtcacattttcttaatccagtctatcattgttggacatttggcttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgctgacttccacaatggttgaactagtttacagtcccaccaacagtataaaagtgttcctatttctccacatcctctccagcacctgttgtttcctgattttttaatgattgccattctaactggtgtgagatggtatttcatggtggttttgatttgcatttctctgatggccagtgatgatgagcattttttcatgtgttttttggctgcataaatgtcttcttttgagaagtgtctgttcatatcctttgcccgctttttgatggggttgtttttttcttgtaaatttgtttgagttcattgtagattctggatattagacctttgtcagatgagtaggttgcaaaaattttctcccattctgtaggttgcctgttcactctgatggtagtttcttttgctgtgcagaagctctttagtttaattagattccatttgtctattttggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatgactagccagttttcccagcaccatttattaaatagggaatctgttccccattgcttgtttttgtcaggtttgacaaagatcagatagttgtagatatgcggcattatttctgagggctctgttctgttccattggtctatatatctgttttggtaccagtaccatgctgttttggttactgtagccttgtatatagtctgaactcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaacttggattcctaggtactttattctctttgaagcaattgtgaatgggagttcactcatgatttggctctctgtttgtctgttattggtgtataagaatgtttgtgatttttgcacattgattttgtatcctgagactttgctgaagttgcttatcaacttagggagattttgggctgagacgatggggttttctagatatacaatcatgtcatctgcaaacagggacagtttgacttcctcttttcctaattgaatgccctttatttccttctcctgcctgattgccctggccagaacttccaacactatgttcaataggagtggtgagagagggcatccctgtcttgtgccagttttcaaaaggaatgcttccagtttttgcccattcagtatgatattggctgtaggtttgtcatagatagctcttattattttgagatacgtcccatcaatacctaatttattgagagtttttagcatgaagcattgttgaattttcaaaggccttttctgcatctattgagataatcatgtggtttttgtctttggttctgtttatatgctggattacatttattgattttggcatgttgaaccagccttgtatcccagggatgtagcccacttgatcgtggtggataagctttttgatgtgctgctggattcggtttgccagtattttattgaggatttttgcatcaatgttcatcaaggatattggtctaaaattcttttttgttgtgtctctgccaggctttggtatcaggatgatgctggcctcataaaatgagttagggaggattccctctttttccattgattggaatagtttcagaaggaatggtaccagctcctccttgtacctctggtagaattcggctgtgaatccatctggtcctggacttttttttttggttggtaagctattaattattgccacagtttcagctcctgttattggtctattcagagattcaacttcttcctggtttagtcttgggagggtgtgtcgaggaatttatccatttcttctagattttctagtttatttgtgtagaggtgtttatagtattctctgatggtagtttgtatttctgtgggataggtggtgatatcccctttgtcattttttattgcatctatttgattcttctctcttttcttctttattactcttgctagcagtctatcaattttgttgatcttttcaaaaaaccagctcctggattcattgattttttgaagggttttttgtgtctctatttccttcagttctgctctcttagttatttcttgccttctgctagcttttgaatgtgtttgctcttgcttttctagttcttttaattgtgatgttagggtgtcaattttagatctttcctcctttctcttatgggcatttagtgctataactttccctctacacactgctttgaatgtgttccagagattctggtacgttgtgtcttcgttcttgttggtttcaaagaactctttatttctgccttcatttcgttacgtacccagtagtcattcaggagcaggttgttcagtttccatgtagttgagtggttttgagtgagtttcttaatcctgagttctagtttgattgcactgtggtctgagagatagtttctgataatttctgttcttttacatttgctgagcagtgctttacttccaactatgtggtcaattttggaacaggtgtggtgtggtgctgaaaaaaatgtatattctgttgatttggggtggagagttctgtagatgtctattaggtccgcttggtgcagagctgagttcaagtcctggatatccttgttaactttctgtctggttgatctgtctaatgttgacagtgggatgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaatccctgcctttttttgttttccgtttgcttggtagatcttccatccctttattttgagcctatgtgtgtcgctgcatgtgagatgggtttcctgaatacagaacactgatgggtcttgactctttatccaatttgccagtctgtgtcttttaattggagcatttagaccatttacatttaaggttaatattgttatgtgtgaatttgatcctgtcattatgatgctggctggttattttgcttgttagttgatgcagtttcttcctagccttgatggtctttacaatttggcatgtttttgcagtggctggtaccggttgttcctttccatgtttagtgcttccctcaggagctcttttagggcaggcctggtggcgacaaaatctctcagcatttgcttgtctgtaaaggattttatttctccttcacttatgaagcttagtttggctggatatgaaattctgggttgaaaattcttttctttaagaatgttgaatgttggccctcagtttcttttggcttgtagagtttctgctgagagatccgctgttagtctgatgggcttccctttgtgggtaacccgacctttctctctggctgccttaacattttttccttcatttcaactttggtgaatctgacagttatgtatcttggagttgctcttctcaaggagtatctttgtggcgttctctgtatttcctgaatttgaatgttggcctgccttgctagattggggaagttctcctggataatatcctgcagagtgttttccaacttggttccattctccccgtcactttcaggtacaccaatcagacatagatttggtcttttcacatagtcccttatttcttggaggctttgttcatttcttttcattcttttttctctaaacttctcttcttgcttcatttcattcatttcatcttccatcgctgataccctttcttccagttgatcgaatcggctactgaggcttgtgcattcgtcacttaattctcatgccgtggatttcagctccatcaggtcctttaaggacttctcagtattggttattctagttagccattcatctaatgtttttctcaaggtttttaacttctttgccattggttcgaactttctcctctacctcggagcagtttgatcttctgaagccttctctcaactcgtcaaagtcattctccgtccagctgtgttccgttgctggtgaggagctgcgttcctttggaggaggagaagcgctctgatttttagagtctctggtttttctgctctgttttttccccatctttgtggctttatctacctttggtctttgacaatggtgatgtacagatgggtttttggtgtggatgtcctttctgtttgttacttttccttctaacagtcaggaccctcagcttcaggtctgttggagtttgctggaggtccactccagaccctgtttgcctcggtatcagcagcggtggctgcagaacagcggatattggtgaactgcaaatgctgctgcctgatcgtttctctggaagttttgtctcagaggagtatccagctgtgtgaggtgtcagtccacccctactggggggtgcctcccagttaggctactcaggggtcagggacccacttgaggaggcagtctgccagttctcagatctcaagctgcgtgctgggagaaccactactctcttcaaagctgtcagacagggacatttaggtctgcagaggttactgctgccttttgtttgtctgtgccttgcccccagaggtggagcctacagaggcaggcaggcgtccttgagctgtggtgggctccacccagttcgagcttcccggccgctttgtttacctactcaagccttggcaatggcggacgcccctcccccagcctcactgccgccttgcagtttgatctcagactgctgtgctagcaatgagcagggctccatgggcataggaccctccgagccaggtgcgggatataatctcctggtgtgccgtttgttaagcccattggaaaagcacagtattagggtgggagtgacccgattttccaggtgccgtctgtcacccctttctttgactaggaaagggaattcccgaccccttgtacttcccaggtgaggggatgcctcgtgctgcttcagctcacgctcggtgcgctgcacccactatcctgcacccactgtccggcactccccagtgagatgaacgcggtacctcagttggaaatgcataaatcacccatcttctgcgtcgctcacgctgggagctgtagactggagctgttcctattcggccatcttggctccacccctcagtacacatgtatttttaagaagtcaggaaatacatagaccaaaatgttagcagaattacatgaaagtagtagggtttcttttttacatttttattttgtcttaattttttttttttttttgtaagggacaaggtcttgctctgtcaccgaggctggagtacattggtgagatcatagctcactgcagtcttgaactcctgggctcaaccaatccgcctgtctcagcctcctgagcagctgggactacaggtacacacaattgtgaccagtttagaacttttaaaatgagtatcttctacttctatgacaagagaaaagatgctttcatttgggaaaagtttatttcctaaatatgaagcctattttcaagcttccccaaactaaattctgttacttctataacagcaaggagtccttcagacaagtcatttactttgtacttagaattagaagttgttatctctgatagggagtgataaatttgtgctgtttcattcaggaaaaccaagagtacaaatttgccatctgcataaccccagttgccagaggtcatgaatccagtctataatagaaaatgctgaaaacataaatggtctacacctcccttttaaggaaatattttcagccaaagaagctaattagccacatacgaagacctatttttagatttttagtactaattttcatatcttttcatttactctatcatgtcttccctttgaaagtttcatatttatatacaaattgaactctttaatttttccttacaaagtagttatcttgtcatttctatcaattctttccatttttatcatattttgacaagatttcttcacatgtatcataagtattatgttctaatcatcatcaaaactgaataggaagaattctattcctgtcttaaagtacaagaactgtgtagtcaatcctctcccctaccctccccaccaaaatctttgtactgccgggtgctcctattatgaataatccatatttcataatcttaatcttataccactgatttttaagatctctaagcttaaaagtattcattttttttcttaacctcttggtgtatatcctaaccaaatatatatatatatctctctctctcaaagattctgtatcattttaaacaacctgtgataattctccaaaaaaaaaaaaaaggtattgattagtaagtcagccaaagatatgagccactcagatctcctttcaagaaagaatttatgactcagctgcagggagggtaattagctattagagccttcaggttctgcatcagcattccggttaaaactattatcttcccaagttatctcccaaccaatgactaagcacagctgtaatactaaggcctggtcatttctgcctaacatgggactccttcgatatacaatcttactcttggtctccctactgggctggctgagactgtcagctctgcatcatggtgaggagactcccctggccctatgttgttttcattaatccttcacagtcattgttcctcaatcaacctcttgcactcctaactccacctcagcatcttcttcccaaaggacctaacagatataatgatttaatactgacacatcagtattattcatcaaagatccagatttaaaattataattctaatacaaatatctatttctctcatttatatgtccccttacattctgccatacctatcagataaaattttaaaaatatggataagctattaaaaacaggtatgcagaggatttgagatgttggttgaggtagttgtttttacccctcattttgatcttgtaaatgcttttaccctggcatcaaggatgtatctttttttcctgagccagtttcactgagccaatatcctatcttgattttctatagcatagttagaccatttattttattaaaaagtgttcatttcactgaattgctggagcaattcatgtacattttgtgataacaattttaatttgttttataaccatatcaatttttttaatgttagcttgtatcacagtaaaatttgggtgagtggcccaatttgtaccttttcctaaccaagtctatttttccaaagtcaaattttacagatctaaattttgtcaagatgatagtgttcctatcagattttaattgacaacaaaattttccatgtgcagctataacagcttttatttgtgttacatctaccctatcaaatggtgggatcaaagattattcggatttaaattctctacttcaaaattatcttcaaattcaggtcacaacttaaatgtcgtcttctcaaaggaataatcctccatctctatgatgaaaagaatgcatgcatccaaaacagaaagaacaaagggaacaagcttagtgtgctggctggacaaaaagaaaatcagtgtggttatagcttggtagaaaaagggatacgggtggccaggtggtacagtatctcttatatgcctcagcccagacatggcacatcaatttgttaaaatttcattgcctaaaattagttacatggcacttcctacgtacaaagagaactacacagggtttctttctgccaaggaaggagaaacaggtgtgagtaagcactggtagcctcaaatacaaataccttccttacggtacttataaagattgaaatgagataatatcaagttcatagctcattgccaacatttttgagtattgaataaataactaatttacactttattgtttttcaagtatacatctaattatacttccttttttaagtgaattgaagcattttttaaaagtcaattaattgaggccaggcacggtggctcacgattgtaatcccaacactttgggaggccaaggcaggtggatcacctgaggtgaagagtttgggaccagcctcaccaacgtggagaaaccccgtctctactaaaaatacaaaattagccgtgatgcacgcctgcaatcctagctactgaagaggctgaggcaggagaatcgcttgaacccgggagggagaggttgcggtgagccgagattgtgccactgcactccagcctgggcaacaagagcaagactccatctcaaaaaaaaaaaaaaaaccaaaaaactcaattgagaaccttgaccaacactaacagcaaaactatttacataaacttccctttttggaaaaattagaagatactttcaaatcaacaatccttcaaacgtttctatagttcatattgtaatttctcaatgactatcactgaccagatcctaggactatcattgacaatgtcctagaacttcattaatccataacaggaaaattgaatcattgctgcatctagatatccatcattcaagataggtagcaaatttgctttttaaaaatgtagtccaggatgaggcaggaggatcacctgagcccaagagttcaataccagcctaagcaacatagtgagaccccccatctccacaaataatagaaacaattagccaggtgtggtgatttgtgcctgtggtcccagctactcaggaggctgagataggacaatcatttgagtccagaaagtcaaggctgcagtgagccgcaattctaccaccacactccagcctgggcaacagagcgagatcttgtctcaaaacaaaacaaaacaaaaataggagtcctcatataaccagaaagtacaaatgaacaaataaaaacgaacaaagaatatctgaaataacgttcgatttaggtccagcttggtggctcatgcctgtaatcccatcaaattgggaggcccaagcaggaggattgcttgaggccaagattttgagactagcctgggcaacatagtaagatcccatctctattaacaattttttataataaaaaaattatttgggtatagtagtatgcatatgcagtcccagctactcaagagattgacggtgggagaaccacttggctgcaggagttcaagcctactgtgagctatgattacaccactgtactccagcctagacaacagagcgagtccgtctctttttttttgtttttttgagacggagtctcactctgttacccaggctggagtgcagtggcgcgatctcagctcgctgcaacctccgcctcctgggttcaagcaattctcctgcctcagcctcccgagtagctgggactacaggtgtgcaccactatacccagctaatttttgtatttttactagagatgggatttcaccctgttggttggccaggatggtctcgagctcttgacctcttaatccacccgcctcggcctcccaaagtgctgggattacaggcgtgagtcaccacgcccagactcgagtctgtctcttaaaaaagtttaaagagtgttcaatgtaaacaaattactttcatttctagtaatgtatattcagtaatttggactaacttctctgatggaaacaaatagaaaagctggataaatctgattaaaggcattaatgagtcaagaaaacagaaaataaattacaggacacagatctggaaagaaaaaaagaaaaccaaaagataaagtcagcatttgggagtacttttcccccagggtatttgccaatctgaaatccagatgaaggtttagaagataagcagggctactgacaggcacaaaggaatgtggaacaaaaactggagccacattttgggaggctgaggcgggcagatcacctgaggccaggagtttgagaccagcctggccaacatgacaaaaccccatctctactaaaaacacaaaaattagctgggtgtggtggtatatacctgttatcccagctatttgggagcctgtggcatgagaatcacttgagcctgggaggcagaggttgcagtgagctgagagcgtgccactgcactccagcctgagcaacacagcgagactctgtctcaaaaaacacaaaaacaacaacaacaacaaaactggagccaaataagggagtgttgttaaatacctgatgcttggagaccatacactgaaggctaccctagggaacctaaaataaactgactatccctgggaatactgcccagcctcaaatcatctcagtacttaaaactggattaaggtgatacagaattactaatacccctatcttgtcttttacttctttgaaaatattgagcaggattattttcttcaggtttattgtgctataatgtcaaataaactgcacatatttaaagcgtacaattaaatgaggtttgacgtgtatatacactggtgaaaccatcatcacagtcaacataattaacacagccataaccccccaaagattctttaggcacctttgtaatccttgccttctacctgttcctaccctagtactccacattcctaaaccaccactgatcggccttctgtcactatagattggtttgtataattagtttagaattgcatgtaaataaatggtatgtactttgggagggggtcacttctattgtataagtagacctgaagttgttgatccattaatccactgaaagacatttgggctgtttctgggttttggctattacaaataaagctactacgaacatccttatataagtctatgtatgggcataaggtatgaatattttgaagcctgtttctgataacactcctatcagattctaaagtacaagaatatagaaagaataaaaggattcaaaaatataacatggaggctggtgcacggtggctcatacctgttatctcagcactttgggggatggaagcaggaagactgcttgagtccaggagctcgagatcagcctgggcaacatggtgaaaccctatctctacaaagaacaggaaaaccagctgggtgtggtggcgcacaccggcaatcccagctactcgggaggctgaggtgggaggactgcctgagcctggggtggttgaggctgtggtgagccatgattgtaccactgcactccggcctgggcaacagagtaaggccctgtctcaaaaatgaaaacaaataaaaataacatgaaaacactaaccaaaagaaggctggtgtagctctattaacttcaaagtggactttcaggaatacttcatattgaaaaaagcttgaattccacaagaagattaacattttcttatgtacctaatggtataaccttgaaagatatgaagcaaaattgagagacacaaagagaaaaagacaaatccaaaataacatggctgggcgcagtggttcacacctgtaatcccagcactttgggaggctgaggtgggtggatcacctgaggtcaggagtttgagaccagcctagccaacatggtgaaactctgtctctacaaaaaatacaaaaattagccaggtgtgctggcacacacctgtaatcacagctacacaggaggctgaggcaaaagaatcacttgaacctgggaggcagaggttgcggtgagccgagattgccccactgcactctagcttgggcaaaagagtgtgacttcatctcaaaaaacaaacaaaaaataaataagtaaaataatagtggacgatgttaacgtaactcttgcagcaactgatgagaacatgtgaacaaacaaaacaggaatacagaagtaacaaaactgacctgaattatacatatatacacacatatatgtttatgtgtatatacatgtataatatatgtatattaacataaacgtgtgtatatgtgtgtatatgtatatctgcatgtatgtgaatatatataaaccactgcacaaactacagaataaaatccttttcaagctcatacaaaatttttaccaaaattcaatttgtttgcaacataaagcaagtttcagcagatttaaaaggactgaaatcatacacagcttcttccctaaccaactgcaattaacctaaaaccaataagactaagataaatagaaaattgccatatacttggaaattttaaaatatgctcctaaataatccatgggttaaaaactaaatttcaataaaaactggaaaatatgttaaacaaaatgattaaaaatacaatatcaaaacttgtgagatgcttccttagcattcatattttggtgcctaatactctactagtaagtgaaccacaatataatggagtaggagaaaaaattggatgtgtctgtaacatcctgctgtaaattttactttcaagatcatagacatcactaaaaaaggaggaaaaggtaaataggggaattatactaattacattttgaaaaactgcacataaaataaaaataccaactaatgatcattaatgttttttattttacaaaagaccgtgacgtcacaacaatggtcaagagaaaacgcaaaatgcactatataaacctaatggtaaatatagtagcttgtttttataatgtatagaaaagtattgatatacatgtatattttgggttttaaaattttgattatgttttatgtgttcatttatagagcacataaatgtgtctgtttttatctttgtaagaagaacagcatgaataaaattagtagtgagccaaacagcactagccaaaagaaggaattatgctacaaacaagaagacccaatcagcactggaggtgccctttagtaactaagtataaggtgagtcccacagctgattagtattggtagttatatccaaaaaccaattagaagaaagattctgcaatgtgtcccaataatacatgagacaaaagtccccaaaagtaagctaactatacagacttaaaaccttatctcaggagatgaaaccctagatgaacatgataattttaatgaagtgcaggcataagttgctgatcattttaggagatatgcatacaattaaaagaacaaaaaaaaaaaaaaaacaggataacctgttaaggctgtctggccaaacaaaatttaaagacttccttatttctgagaaaggtaaccaattttcaaaataaatttataggaaagatgggaacttaaaagtaccatgatataacacataaaactcagattaaatggagacttggtctagagaacaatagctgaaatacgaatcatcatggactaagaaatcagttttcatgtccaacacaaaaatcaaatggtgagtgacacagaatcagtatctttgctgatctgagaacgcatgctctttacctttgagtttggtggtatgactaaaacccagagaagtaaaaagcaaaatataattgcaactggttgaattacctatacctacaaaaacagaaaaattggagcagtagaattatattatcatcaggatatgaaacagtaaaattcatggtatttaatgatgtaactggtttggggtaataatttagatatatggtgcatttttttctgcttcttaatgtgtttagatcatttgaaaaacacttattattaaattttatgactccaatcaataaaagtattaaagttcgcaatacgtgtttaaatatctgggaatttttattgcattatcagtaagtttgattatttgcataaggaatataagaatacttagaggaatattagtgtttaatatctaaagatataccaattgtttgacaaattaatattaatagattaaacaaatttgtgtcacagattagagtgcttaaaaaaatttatagcttgaaatgcatatacaagagagaaagtggccaggagcggtagctcatgcctgtaatcccagcattttgggatgcagaggaagggggatcacttgaggtcagaagtttgaaaccaccctggccaacacggtgaaactccatctctactaaaaatacaaaaaaattagccaggtgtggtggcacacgcctgtactcccagctacttggggggctgaggcaggagaatcacttgaacctgggaggcaagaggttgcagtgagctgagatcataccactgcactctggcctgggtaacagagcgagactgtctcaaaaaaaagagaaagtaagtaatgctaaaaatcaatgatgtaaaaattcatccaaggaactttgaaaatggacagcagattaaatccaatgaaggaagtaaataaagatgagaacagaatttttaatacaaaaaaatatacaatagagaagaatgacaaagctaaaagttggttgttaatttgataagctcccagcaacacaaaacaaaaaaaggcggcaataataatcaaaatcaggaaacattacagatcctactgacttcaaaaagataaaaaagtatattatgaacaatgttatggtaataaatatgaaaatctagatgaaacggacaaattcctagaaaacaacttttcgaaactggctcaagaaactgaaaatccgagaagcagatatctataaaatgccacaataggaggttccaaaattcatttctccatggaaacacaaaattaacaaccatctaaataaaaaattaccttcaagagaactccagaaatcagccttcagcagattcccttggcccacaagttctccaatgggagaaagaaagagtaaggtgagtgtctacctttgccacaaatcctagcaccaggcctgtccacctacagaccacaccaccagactgaccctactccctgcagacccacttgcccacagaccctaggacctaacatgcctgcccacagacacaaaggcaggtgtgttaggtcctagggtctatgggcaagttaggtccactggtgtctatgggcagtggtatgtccaaggactggtcctagcaccaaagtatttaaaaaataaaaactacccacaaaaatgtgctgataagatacacaacataaagagtcgttctgacataaataacatagagtgtgtggcaaaggcattataagtgtatagtttttatatgcaattgaagttaagactgtatcagcttcaaacagactgtcataactattaagaaattttatgcaagcctcaggataaccatgaggaaaacacccatagtaggtacaaaaaaagataaaaagaaaaaaaagtatattattacaaaaaaaatcatcatatcaaagtgaaaacagcaatacaaaacaaaaataactataaaacggacagaaaaaaattaacaatggcaatagttcttatctatcaatcacgttaaatgtaaaattcaccaatcaaaggaggtaaagtaatgaaaggagttaaaaaacaagatccaactgtatgctgtctgcaacaaatacaccttaaatttaagaacacacacaagctgaaacagaagagatgaaaaagggtatttcatacaaatggtagccaaaagagagcaagggtgactgtagttacatcagacaaaatagactttatgtcaaaaactgttaataagagacaaagaaggtcattacataataataaaagggaaaactgaatacaggaaaataaaacaattatatatgcatgcaacataaaagctgctaaatacataaagattgacagatctgcaggagaaatagatagcaatagaaaaatactaggatacttcaatcaccacttaaaataatgaacaaatcatccagacagaagatcaaaagaaaatatcaaacttgaacaacactatagatcaaataaacctaacagacagatataaaacattccacccaaaagtagcagaacacacagtgtcctcaagtgcaaacagaacattctacagggttgatcacatgctaggtcagaaaacaagtcctaacaaatataagaagtttgaaataattccaagtatcttttccagccacaatggaatgaaactaaatcaaaaacaaaaagaaaaaaattcaaaaatatgtggaaattaaacaatatattctggaacaactaatgggtcaaagaagaaaccaaaaagggaaattagaaaatatcttgagacaaattaaaacaaaaatctatctcaaaacttatgggatgcagcaaaagccgtactaagattgaagtttataatgataaatgcctacattaaaaaaagaagatctcaaatcaaaacctaacattataccttaagggtctagaaaaaaaagaacacaccaaacctaaagttaaaaaaatgaatcaaataataaaaattagagtcaaaataaatgagaaagagacgagaaaaaaaattttttaatgacaaaataaagagttttttgaaaaaattaaattggaaaacccttagctagactaagagaaaaaaaacaaaagaagactcaaaatcagaaatggaagaagagacattacaattgatgccacaaaaataaaaaacatcataaaagacgattgtgtacaattatatgccaacaaattggacaacctaaacagataaattcctagaaatgtataatctaccaaggctgaattaagaagaaatgaaaaggccaaaaagaccaataacaaatacggagattgaatctataatcaaaaaccaaacaacaaagaaaaggtcaagaccagatgacttcagggataaattctaccaaacatttaaagaattatcaccaattcttcttaaattatttcaaaaaaatgaaaacaaggaaatttgtaatcttcttttataaggacagcatcaacctgatatcaaagacagacaaagacacaagaaaactacaggccaaaatccctgaaaatagatgcaaaaatcttcaacaaaatattagcaaaccaaattcaacagcatgttaagatcataaaccatgaccaagtggtacttccctcctgggacgtaaacataggccaatatacataactcaagacaagtgattttttgtctttcttgcctgtgattttagtgtcatatccaagaaatcattgccaaggctaatatcaaacagcttcttccttatattttcttctatgagtttcatcgtttcaggtcttacatttaagtctttgagttgatttttgtttatggtgtaaggtaagggtccaatttcattgttttgcatatggatatccagttttcacaacaccatctgtgaacagactgttctttcctcattgtgtattcttggcacccttgtaaaagatcagttgagtatatgcatggatttgtttctaggtactctattctgctccaacagtctacaagtctgtttgataccagtcctgcactgttttgattgctgcagctttgtaatatattttaaaatcaggaagtgtgatgcctctagctttgttgttcttgctcaaaactgctttgggtatttgaatcttttttggtaccatacgaattttaggcatgtgttatcctgtttctgtaaaaaatgccaatgggattttgacaggaactacaccaaaactaaaaagcttctgaacatccaaggaaacaataaacaaaacacaaaggcaacctatggaagagagaaaatacctgcaaactatacaactgataaaagattaatatctaaaatatacaaggaatccctacaactcaatagcaaacaataacataatttaaaatgggcaggccaggggcggtggtgcatgcctgtaatcccagcactttgggaggccaaggggggtggatcacttgagctcagaagttcacgacagcctggacaacacagtgaaactctgtctctacaaacacaaaaaaattagctgggtgtggtggcacacgcaggtagtcctggccactcaggagactgaggtgggaggattgcttacaaccaggaggtcaaggccacagtgagccgagatcacaccactgtactccagcatgggcaacggagtgagaccctgtctcaaaaaaaaaaaaaaaaaaaattaaaatgggcaaactaattagatatttatccaaaaaagaaatacaaataaccaacaggtatatgaaaaagtggaaaacattactcataaaaatcaaaaccacatggaggcctggtgtgggagtgcatgcctgcaatcccatctactcaagaacccgagtcaggagaatgctgcttgattccaggagttccagactatagtgcacaatgaccttgccattgaatagccactgcactccagcctgggcaacacagcgggaccctatctataacaattttaaaacaaacaaaatgagatatcaccttatgtaagaatggctattattaaacaaaaaaaaagataagtaatgttggcaaggatgtggagaaaagtgaccctttgtatactgttggtgggactataaattggtgcagccactataagaaattatggaggcacctcaaaaaattaaaaatagaacaaccatatgagctagcaatctcacttccagatatatacccaaaagaactgaaatcaagatatcaaaaagatatctgcactcccatgctcactgcagcattaatcacaatactcaagacatggaaacaagctaaatgtccattgacagataaatggataagaaaaatgtgggatataaatacaatgaagtgttatttggccttcagaaaggtatcttgccatttgtgacaacatgggtaaatctgaaggacactacgctaagtgaaataagtcagacccagaaggacaaataccatttatagggggaatctataatagccaaactcacaaaagaacagtagaatggtggttaccatgagttgagggtggagaactggggaggtattagtcaaagggtataaagttacagttatacacgtgaataaatcctagagatctattgtccgacatactgcctatagttaacattatggtatacttaaaattatacaaagacactagatcttacgttgtgttcttatcacacacaaaaaaagaaagagtggggggaagcttttgaaggtcctggatatgtttatggcatacactgtagtgacgctttaaaaggtgtatacttattgccaaactcctcaatttgtatacattaaatatgcacaggtttcttttctttctttcttttttgtgtttttgagactgagtttcactcttgtcaccgaggtggagtgcaatggcgcaatttcggctcactgcaacctccgcctcccgggttcaagcaattctcctgcctcagcctcccgagtagctggggttacaagcgtttgccaccatgcccagctaattttggtatttttagtagacacggggtttcaccatgttggccaggctggtcttgaactccaacctcaggtgatctgcctgcctcagcctcccaaagtgttgggattacaggcaagagccaccacacccagttgatatgcacaggtttctgtcaataaaagacaatcatatgtcaattgatatatgataaaaagacaagcatatgtcaataaagaaattaaaactctgaaaaatactataaccattaaaaacaatgaatctaaaatctttccacaaacaaaactccaaatccagatggcttcaccacttaattataacaaacatttaagaaagaaataacactggccttgcatggtgggtcatgcctgtaatctcaccactttgggaggtcgaagcaggagaattgcttgagtccaggagttcaggaccagcctgggcaccatagtgagaccttgtctctacaaaaaatttacaaaagtagcccagcatggtgctgggcatggggcatacacctatagtctcagttacttgggaggctgaggcaggaagatcacttgagcccagatgttcgaagtaaaagtgtgctatgattataccactgtgctaggtgacataaataagaccctgtctttaaaaaagggaagacagaaatcacaccaatcttacataaactttcagtgaaagaaacattgggtggaatgtaacactttcccagccagcacattattaccaaaaaatgacatggaaaacacaagaaaagttacaagccaatgtgactcataaacacacatgcaaaactcctaaaaacattagcaaacgaaatcaagcaaactacacaaaggataatatagcaaagcaagttgcatttactaaaaatgtaaaataggcttaacatttgaaaatcagtctctgtcattcaccacaatttaggaatttaaaacaacaatcaggctgggcatagtggctcatacctgtaatgccagcattttgggaggccgaggtgggaagatcacttgaggtcaggagttcgagaccagcctggccaacatggtgaaaccccatctctactaaaaatacaaaaaaaaaaaaaaaaaattagccaggcgtggtggcagtcacctgaaatcccagctactcaaggaggctgaggcaggagaattgcttgaacccaggaggcagagattgcagtgagccaagatcgtgccactgtactccaggcctgggtgaaagagcaagactccattgcaaaaaaacaaatgaataaaataaaataacaatcaaaataggaggcaaagcaagatggctacatagaagcctacaacaatcatcctcctcacaggaacaccaaattgaacaactatccacagaagaaaacaccatcataaaaaacaaaaatcaggtgagcccttacagtacctgattttaacttcatattgttcaaagaggcactgaagagggtagaatgaacagtcttgaattgctgacaccaccccttcccagttttaaagattattggtaaaataaaaatgtcttcaaaagtgtaaacatttggtctaaattatgcaggtcagatattaagtttgttaaatggtctaaggtcataagctgcttctttgacttttaaaaattgttcaatttattttggagcattacattctagataaggcctggcgacctgtgaaattacccatgccccctagctaggcaaagaaggtattaaagaaaagagattttatatatgaaaggatcttgtataataaatgtttgtcctaaagctaaagtaaaatgactggtcatttaaaaagagggatgtttaggacaagtcaaaaagtctaagcatgttgtaggtggtctgtgttaagtcatgaaagaattggtgaaagggaatttatgcaagaaatgcagtacaatttaaaggtgattaggcctcttaaatgcttcataaaatgccactatgactcttaactgtactacttgcctgctttacagttaggtaaggcttgggacttgtggagtgagatgctggaaagagtcagaccttatcttcatttctgtctgggtcctaggctccatgcctagtacataattaaaatgctgaacttaccaaggtttttcaccaaaagtaaaaatgctaagggttaacagtgtaatgtatatttgaaactactgaaaaaacagttttacatgcaaggtgtgtaaagaaagttaaatgtgtttttggtaaaagattattaaaagtcatgggaatgtgaattttttgcctaactttagttaaaggattgttttaagtgaaataggaaaaatctaaaggtttaaacaacttgtggaaattctgtaaaaattaaccctgtaaaacaaattctaggccgggcgcggaggcttacgcctgtaatcctagggctttgggaggccgaggtgggcggatcacaaggtcaggagattgagaccatccaggctaacacagtgaaaccccgtcactactaaaaatacaaaaaaattagctgggggtggtggcgggagcctgtagtcccagctactcaggaggctgaggcaggagaatggcatgaacctggcaggcagagcttgtagtgagccgagatcgtgtcactgcactccagcctgggtgacagagcaagactccgtctcaacaaaaaaaaaaaagaaagaaattctatgtgtgaaaatattgactaaatttaaaggggtattatcttgtttttctgtaaattgaacatcaaaataaaagcacaacagggttttcttaaagcacgaatctgctctttaacaaaaaaaattgtaaagggttataaaaggtttataaaaatctctccttatggtcaaactgattaagattggacagatttgtctaatgaggctttattaaaaattggggttgacattaataatctactaatgtaagagtgaaatatggctttctcgaacaagattttcatgtaatattaaaagataatgaaaaatgtatttgccttttaaatacactatcaaagaaaaaaaagaagggaaagacaaaagattgtttgaaaagctaagtcttccctctatcaatgagtaaacattgttgcctttttaaaaatttttgtctcattattttggctaaatgaatgacttacagtaatgtggaattccagttcataatatcaagtgttttatacctttaacatatttaataagcttccccaaatcaaatttcagcttccaaatagtctcttctgacttctaactttggaatgctatgggggagtccatagcattggaatgctatgggggagtccatagcattggaatgctatgggggagtccatagcattggaatgctatgggggagtccatagcattggaatgctatgggggagtccatagcattggaatgctatgggggagtccatagcattggaatgctatgggggagtccatagcattggaatgcatatggaatccctgaagcatctaaaagagacgtaaagagaattatttaacatgttaagttacatgggaagcattgtcaaaataatgtttaatcttcaggttatattttagtgaatattaatatatgctccaaaattgtatgggatttctaaaattctaatacgtctgagtatatgctaccaatcataattatggttaagttttatacaccatagaaacaaccaaatatccttgggtaaaactgctaacccaagcagaaccaaaaagttaattaaataccaagaaaatactttgccagattttcatgttaaactagctgatactaaaattgtttagatatacaatttgaactccatggtctaagttaaactacctatgataacccattagttatctgcgctatgcacctaaattgtagaaacaagtggtattcaagaggatgtaagtccaacgctaagcatggactcagaaccaggacagctgccttgtccttcttgagtccttaaggctcttgttattaaagggtctgcattccatgactcatcatgggaaggataaaatgatccaaattgaatatacagatgtggtgacttataaattgtgaaaattagtttaaaaccaatgtttggttccatatttctgggaagacaatcaaaccttcagatacatttggctacctgatgggtcatttaaacatttataaagggatttcattcaattgtcattttcaatgcatgttttatgttataatagttaattattacgccacagtatattttcaccaggtaaagaaagtttttatggttcactaaggacaatcaactccttcacaatatagaacttgaagactggatgttctgagaacatcagagaaagactgcccttgccattcacactgcaacaaaacttgggaagcttgaaccttgggttaataatctcacaactgagaagggtccctccacactcttggaaactgtacacccactggaacccttaaggtaaaactaaccaggcaagtttctccccagaagaaaatggcatccttaatgtgaacagcttttcctaggatcatggatcaagacttctactatcattagactcttatcttcgaatattttttccttatttatgcctccatgaacaatagaaatgtaaagggggtctattacgtgcacttatagggtatacttttatttgtagaggattttgcagccagccttatacatgaataaccttatactttggtagataaaagatgaaggcccgatgtagatgcgaaaccttaatggtacatatgttgcctcataatcagtcaaaactctcttaacccacatcatgggccagaaagaatattgtcaggaagccttcactcttctagaaggacatcatttgttagatcctttttccatgatttagaataaaagaggcaataataaaaaatgtatccctcataatagactctatagcagattctactgtaaaggctatggttacacaacagactttacattttcttgtgaaagacatgctaaataatagaattggctaaacagaaaagtacctgtgcagctactgacacttgtggcctatggacaaatccatcaaatgtagattataaaatttcagttgtaggggattaatgaaaagactacttattcaagcgagtagactcctcatctagctccttctttaatctatttaatcttaggtggtttggtttatggggactctggataaggagcacactccaaactcctggcattatcctcccaatagtcatgataatagtctccctggtgcgctgtattctctcaaaggttttaaatgtttgcatgcagccatacctagaatgtcaaatggtctctcttcaactggaatgacaaaagttgaaagaaatatgcgactgtgaggacacagtaacctatgaatgatgtgcagagaccagaaacccaaaatgatagaaacagagagtggcactaaggtcctaggttttggtcactctctcacctaagggagaagctgaccaaaatggggaaatttttttaaacaaaattatgggaggctaaagtttggactaagctcatgcacgaggccccaacaggccaaaccaaactaaaatggagtcatcatgctaaatgtgacataatcaaacttaagacttcaaggaaacacctagatcctagaacagaccaggttctgtttgcctcctgtaaacaggatgttccagcataaggaggtaccctctactcagtccttgttcttgcttttgcaaaactcactgttctactatttcccagtgggtttcaagaccaaataagtacatttacaatggtgatagtgacatcaataactaaagttttggtcaatctctcaaaattgagaaaatgaccaaaagtgggaaattgttaaagcaaaccaaatatggcctgagaaggactctgtacttctatatttgagtccttgtggacgaactgcaacctagcttaatatgcagacaagactgaaaacctaacttaggagtatgtgtctgtaataatagctaaatcttggccaatcccatcggccatacttcaaccattcatagactgctgagtgttaaaactgtgttcaaataaggcaaacgctggccgggcgcggtggctcacgcctgtaatcccagcactttgggaggccaaggcgggcagatcacggatcacgaggtcaagagatcgagaccatcctgactaacacggtgaaaccccgtttctactaaaaatacaaaaaattagccgggcatggtggcaggcgcctgtagtcccagctacttgggaggctgaggcaggagaatggcgtgcacctgggaggcggagcttgcagcgagcttgcagcgagctgagatcgcgccactgcactccagcctgggcaaaaatgcgagactctgtctcaaaaaaaaaaaaatcaaaaaaaagaaaataaggcaaacactgagctgtaaccaatccagcagttctgtacctcacttccgatttctctatgtcatttcccattttttgtctataaatcttcttccaccacgtggctgcactggagtctctgtgaatctgctgtgattctgggatctgcccagttagcaaactgttcattgctcaattaaactcctttagatttaattcagcttaagttttaacatgggaaaaacatattgacagacaactagcaacctccacacaagaggtaaataccaaaaaaaaaaaaaaaaaaaaaaaatcagctttagaagtttcagaatttgcctctagagaaaagaaaaatgatagcaggaattagagcgtagtgttaaggaatactagtttctataatatgcttctacagatctgactttttaaactatgtgcatatataatataatgaaaataaaaagagttatgagagaaaggaaagcagaaatgagccacaacttgtttctgaaagcctgtctttttctttttgggaggagatgcaagagatagacgtaagaactatataaaatcaaaagtaaaccctgtctgcacattagtactctttaagacagtgattttaactgcttggaaacgcttttcttaatttctttttgttcctggatatatccctgattctgtggagaaacagaatattatggcaaagaatctctaaatcacagactctaccaatacaaaactacaatgattacttttgggaagtctgcattactttttgctaaaaggggcactttttctcataaaggaaaaatcaccgccctgatttttcaatttaatatctcaattgccctgagatattactataatgaatcacagtataatttagtttgtcagttattaataccataattcacacattaggaatctccaaatctccaaaaaaaaacaaaaaggccttctttgttcttctgcccccttatcacgctgatcccagataaaaagcctaggtaagcactgagtgaaaaataaatctggccacaagatacatgaaaaaatattcaacatcgataatagtatgggaaatgcaaattaaaaccacagtgaaatattacctcacatctgttaaatagttattatcaaaaagataaaaaatagcaagtgttggtgaggatatagagaaaagggaacccttacacactgttggaaggagtgtaaattagtacagttattatggaaaacagtacggaggttgctcaaacaattaaaaatactcaggtatggtggctcatgcctgtaatccccacactttgggaggcccaggagggaggatcacttgagcccaggagtttgagaccagcctgagcaacatagtaagactcctagctctacaaaaaataacaatattttaaaaattagctgggcatggtgctgtgtgactgtggtcccagctactcaagaggctgaggtagtaggactgcttgagctcaggaggtcgagactgcagtgacagtgcactccagcctgggcaacagagcgagaccctgtctcaaaagaaaaaaaaaaaaaagaactacctatatgatccaactatcccactactaggtatatatccaaagaaaagggaatcaatatctcaaagcgatatatgtgctcacatgttcattgcagcattattcacagtagtcaaagatatggaatcaacttaagtgtctatcaacagatgaatgaataaagaaaatgtggtatacatacacaattgaatactattcagcctttaaaaaaaaaaaaagaggatgggcaccgaggctcacgcctgtaatcccagcattataggaggctgaggcgggtgggtcacttgaggtcaggagttcaagaccagcctaaccagcatgatgaaatccctattaaatatattaaaaaagttagctgggcatggtggtgcatgcctgtagtcccagctactcaggaggctgaggcagaacagcttgaacccaagaggtggaggttgcagtgagctgagattgtgccattgcactccagcctgggtgacagagtgagactctgtctcaaaaaaaaaaaaaaaaaaaaaaaaaaaaaaaaaaaaaaatcctattattttcaaaaacatcaatgaacctggaagacatgatattaaattaaataagccaagaagagaatgatctcacttatacatggaatcttaaaaaactgaaactcacagaagcagagggtgaatggtggttatcagggactagcaggtgagaaggattgaggagatggtcaaaggacataaaacttcagttagccaaaagaaaaagttcaagagaactattgtatgtcatggggactatagttaaaaataatatactgtattcttgaaaagcactaaaagagtagattttaagtgttctcagtatacaaaatcagtaagttaatgtatatgttattcagctagattagctatttctcaatgtatacatatttcaaaacattatgttgtacatgataaacacacataaattttatttgtcaattaaaaataaaaatctttaaacaaaagaaaaacaaatctactggtttgtcaagttctttgggggaaatggttataaatatttgaaatataaataaaggagaaaaaacagaaacacatggtagcaaaagtaaataagttactgtcagttctgtgaagatacattatcctccagatattcgttttacataaacaaaagtggtagagcaacactgaacactattaggctttcctagtgcagctgcatcaatattttaatgtttacttagattgaccataatagttcctctttttctaactttttcacatttattatctctgaccatttctaaatactatgaacaatgacctaaaaaagcatttttgctgaatcaaaaagtcagtgtgactaattcaaattatagaaagaaaatggtcatccataaaattaagagttacctaagatcatacatagctaatgaatggcaaagatataaaaccaggtctctttaccccattactgaggaaactatgtcaaaacaggaaagaagcacaactttagtcatgtttccctggtcaacagcgccacaagcaaagtccctgttgctcccacctgtcaaatcagtcaacaccattcacatcaactaagtaaattattgtgctttacttacagggtgtattacacgagatgggctctttccaattgccaaactatatgcagactcatttgagctacttcataaagaaaatttagtataagaaaatgtgggggaatatgaaaatataagaaaaatctccacaatcaggcttcactgacaactgcagcactggccaggataaaataaaattggttcccaataggaaggaattctggttgattattgtcaaaatttagcttcccaactctgcccctattatgactgtagttttattttactctccacaataactactctctttctactacatgatttctactgtcctgcagcttctgcttactacattctctgatatctcacattgaaattccctaagaaagataagattgatttaattcatcatttacagagctattggacagagttcctgggccaggccaagctataagccactggcctacctatatatcactgatgccagttcctggtccaggtaattgtggcaaagaagaatggcttcataacaaagcataacaactgatacaagcccttgaagccgcattagtcagaaatgagctatggttgtagcttccactaagagcactgtttgcccatatacatttggattataaaccaaaatcctcattagataaattcagacttaaaaatctggcctaccctctccagggtatagtctcatactgtcacccctatacacaatactcctttcacagcagatccaaaacagcaatctcatctcacaccagcccccataatttctactcctgacctggaaaacgtaatagcatctctctcatcaaaatcttttctctaaattgaaattttcctttgacccagtatttatcccatatttatcctataacgaagtctgacacaagaattatgctagacgaaactattcagatgaaagataattatttattatagaagaatgattgtactaactggtacatccaaacacttcctagtaaaaatacaggtaaattttactgatcaccatttattaattattcaccacgtcaggcactgagctaagcacttgacaggaaacatcacgcattagcaaactcaggcccagaaaggttaagttcttatccaagatcacatctaataaatagcacaactgaaattcaaactctatctctgtgatgccaaagttcatgtttttaacaattatcccatactgtcaatgactgcaaagtacaatcatcaacaggattttatagcattgactaatcctacctctttccccacaaaaaaatcttccaatgtgctctaatgcaatgattcccaaaacactatgcagtgagatatcatacagtaagaaagttctatgaccaaataggcataagaaatgttacaggccaggctcagtggctcacgcctgcaatcccaacactttgagaggcctaagtgggaggaccacttgagctcagaagttcaggatcacctattatcagtagaaaccttgtatctactaaaaattaaaattaaaaaaataggcatggttgtgtgtgcctccactctcagctactcagaaggctaaggtgagaagatcacctgagcccaggaagtagaggctgcagtgaaatacgatagcatcactgcactccagcctgggtgacagagtgaggccttgcctcaaaaaaaaaaaaaaaaaaaaaaaaaagaaatgctgtactaaaaagagcttggtcaggcacagtggctcacgcctataatcccagcactttgggaggccgaggtgggtggatcacttgagcccaggaatacgagaccaacctgggcaacatggtgaaactctgtctctataaaaactagaaaaattagccaggagaggcaggaggactgcttgagcccaggaggcagaggttgcagtgaaacgagatcgcgccagtgcactccagcctgggtgatagagcaagactgtctcaaaaaaataaaaataagtaaaaataaatttaaaacagagctcaaacttctatattgtaggacatatcagaatttttaacatgccaatccaaactatgaatctctaagaggtataaatacacacacatacacacacacacacacacacacacacacttttttttttttttgagacaggatctccctctgtcacctgggctagaatgagtggtgcgatcaaacctcattgcatcctcaaactcctgggcttaagcaatcctcatgccccagcccccagagtagctaggactataggtatgcactaccacatctagctaattttttatttttattttttaaaggtagggtctctctatgttgcccagacaggtctgaagctcccagcctcaaacaaacctcccactgtggcttcccaaagtgctgggatttacaggcataagccattgtgcccagccaagaggtaaataagtaaagatattaagcagagtttctcataattatttagctgaagttaccactcttcacaggccattgcctggaactcatgttttgtggaatgcaccttagaaaatgcttatctagtaaaaaaaaaatttcacatgaccatctttttctttgataatttcaactaaactaggacagttactaatcagtaaatcttatgattactgctcatccatacaccacttctaggtgaaaatgtcatggccacgctgagggccagtgaccatgttttggatcatgtaactttactcccattctgagataactggacagaataggcaccaaaggaatatagcccattcactacatagtctgcctcaaaaagattagttgggcaaataagatatatctttaaaaatgggaaacaaacaataaagcagagggtccagaagagccatatagtgacaatagggcagcagatggaaatcacaaaggagtaagaaactactaataagcaaaggaacagagcaaaggccaacagaaaaaatgaggggcagggaacagagaaggcatagagaaaagtaagagatggactctgttcacatttggagctagttgtagctcctgggaacctagtccttggacttctatgagatctttattgtacccttataatattgtacccctttggatttaactagcttgagaagttgtcttttccttgcaaccaacactatttaaattcacacaaggagagtttaatttccttgtgtgaaatgaagtagtacaagtcaggtgttaagagcacaggttgtagagttagaatacttgtaattaagcccacatcttttattgttaagatgcaaaatttggggaaagttaactaaagcctccaattcccatgtataaaatggaaatgaaagtatctccacctcagtaaggctgcaaggattaaatgagctgtctgtaaagtgctctgtacatagaaagcactgaataaatgttagctattattactactaatttgcatgcatttcttttctctcactcaacaggaaaaccttgtccttagaacctaactaagaaaaaagaaaaatcctatttctagatgtaaacatctgataaatattgcttttcaaaaaatgtattagtacactgtagccacaaggccttagccacagggaatccctcaccctttgtactttttatagaactaataatattaaatactctgaaaatatgtttgatcttaacaaaataattcttccaaaacaggataaaaatgttacatcaacaccagatataccttatctaaagcatcaacatttttagagattccgaaacataacatattttaaagggcaacaaaataagcctactttataaaataaaaaataattttttattttgagattattatatttggaataaacatgcagacctactataataacaaaaaatttaaaagaaaaaatagtagcttctcttgaggacttttaataacacacaatttcaaatccaaaaacaagtgatctcactaccatttattagctgattttaacccaactaatgcctgaatcatattaatttcactccatatattcgaatagttatttgcttactaggaacaatttatacttaagaaatttatctacatcattctctgatttggatagtttgggttctcctgcctgacagcaaaatagttattcagatcagctttagaaataatataaaaaattttaaaaggccacaatagtttttaatttgcccccaacccataatgtgttaataaaattagaagtctgcattatttgtatttcaataagactattactcatctttcataagtaattatgtccactaagggcacattttggcatatgcaaagaagagccaatatctgcagagcacaatgccacacacctgtaatcccagcactttgggaggccaaggcaggaggatcacttgaggccaggagttcaagaccagcctgggcaacatagtaagaccccatctctacaaaaaaaatttacaggtcgggcacggtggctcacgcctgtaatcctagcactttgggaggccaaggcgggcagatcacgaggtcaggagatggagaccatcctggctaacaggatgaaaccccctctctactaaaaatacaaaaaattagctgggcgtggtggcgggcacctgtagtcccagctactcaggagaatggtgtgaacccaggaggcagagcttgcagtgagccgagattgcgccactgcactccagcctgggcaacagagcgagattccatctcaaaaaaaaaaaaaaaaaagattttaaaaattagatgggcgaggtggtgtgcacccgtagtcccatctactcaggaggttaagacaggaggattgcttgagcccaggagtctgacattgcagtagctgtgattgtgccactgcactccagcttaggcaacagagagaccctgcctcaaaaaagaaaagaaagaaggggagggagggagggagagagggagaaaagaaaaaaaaatagccaatatttaagcaccactacgtaagtagtaacaactctgtaataaaatggcaatccaattataaaataggcaaatgatctgaacagacccttcaccaaagagcagaagaaaaaaactgatcaacatcattaatcagcagagaaaactagaaattaaaatcacaatgagatactagtacatatacctcaaaatggctaaaatcaaaaagactgacgatgccaaatactgatgagattatagagtaactgaaattctctttttgttgtagttgttttgattttgaaacagtatctcactctgtcacccaggctggagtgcagtggtaccatctttgctcactgcaacctccacctcctgggctcaagcaatcctcccgtctcaacttaccgggtagtggggactacaagcacatgccaccatacccaacttatttttatattttttgtggagagcgggttttgccatgttgcccaagctggtctgaaactcctaggctcaggtgatctgcccaccttggccccccaaagtgctgggattacaggcgtgagccactgtgcccagccaactgcaattctcatacattgtcggtggagacataagatggtataccactttgggaaaagatgtggtcgtttcttataaaactaagcatacacccacctataacccaaaaattcaactgctaggtatttacccaaaagaaattaaaaactacactcacaaaaacacttataagaatattcatagcagtttattcattattgccaaacactggaaacagtccgggtattcatcaatagaatggatatgcaaacttgttgattcacataatggaatatcattcagcaaaaaagggaacaaacttctaacaaacataataatgtggatatacttcaaaaacatgctgagtgaaagaagccttacataaagaaatatgtgctatatgattccatttctatgatgttctagaataggaaaaattaatctatggcagacaaaaaaatcagaacagtgactgcctctgggaggacagggcaggaagtgactcagaaggggcataatatactgtatcttaatacatgtttaaattacaaagatgtgtaaaattccaggaatgtaaatttaagatttatttcattatatgtgaacattgcatcaaaagaaaaaaaaagtccccaaaattgcattatggttaattatatgcatgccaaactagtttgggggaagatactggtatcaataatttactgtgaaatacatccaaaaaaagatagattagtggatgatataggaatcaacagatggagtaatatatgataaaacaggtataataaaatgttaattgtacaaagtgtaggtagtactatacaggcgtttggtataaattctttcaacttcgttgtatttgaaatttttcataatcaaatgttgtagaggaaaaaaagcctcatccaatccttcaaagtgcaactcaaaataaactacttccatgagccctttcctgtcaccctcagccttctgaacctagtcttactgtctagagcactcacctggcaatatgataattatctttccacagacatctcatccttataaaatagactataagcctcttaggggctgctctctgatgcgagggtagaaaagagtttagtgatctgtttattatgctttctatgtatgtataaattattttattttataaaccgtaacttccaaaagacaactgtcagtcaactaaaatgtaaatacatagatgtatatgcatacactacacacacacattgaaagctaaaaacttttaaccaagtatccttgatttttttgagtccttgattaatgaaatatcctatacctgctgaattcaacttaatagttcatctatgcaaaaataattggttgatgctttctctaaatgttctgcaaagagctatgacaccagaggtctcagattctttacctgaggataaaaggatcctcagggagtctataattttactaccatataagacgaaaaaaaaacttgcattaacaagtaatgacattctttaaaattaataaatattttatcagtgttcaatacaacatttaatcctaaagaaattgtactacttccctgttttaaaaaattatatacaatatacatttagaatcttaaaatctcctccttatagataccttctttctatacctattgaaggccaattgataaatcattcaagaatcttctgttatccttttaaataaaaaaaatcagcacaataaatcaacatttcagacaaaagaaaataagcacattattcatattttatatggttttaataataattacacatttttatcccccaaagaaaaattatgaagctggaagtatcagatatagtaaaaattcaagtttttttttaatttgtgtgaattataatgacataatgctggaagaaaccacactttactttctgtttagaggggttgccctgacttccatgtatgaatgatcaagagaatgaattacagtcttcttaaaaccttaatgataactatggttaattcaagctacaataggttaattactagtatcaagagacatgcagtaacttctactagaataaactctgacctttaaataagtcagagactcttactactaataagtacctaattaaacattaggttccttatttataaagtgaagggtttgtataaaatctctgctgtacttaagaatagaagcctttggctacattagagaatactcaactccattcacccggaaaaatgacatagaagaatataccatatcaaatgaaaactttatcctggctgaaattaaactctctggaatatattaaacacatttgaacatccttacggaaaaggtgaggaaacacttgaacagtccaaattatccacttaaaaacgaaaaaacaacaatatccaaaaatcccatcattcaagcattatctgaggaaaattatccaaacaggtcttaacaataacctgataactacaaaaatattcatgatttataaagttaatattaaaaaataagaactacaagataatccaaggtgcttatgtgaatgtgcttctgccttaggtaaagcttactaaggaatatttgtcaacagcaggcagcttggagatcttcaagctttacatcatcaaattccaagatggttttactgccaaactgccctctttatagctcttgagtattccttataatggggaaggaatgctcagcaaccataatcttcctcccactcctatcagtaactggtacagtgatacttggtcaccttcttctctaatccaaatactcacaatacttcagggaaataaagctcagcttctcattagaaaaaatgttgagaataactgacagagttataataaagatctcacctatgtatactaaaaattcttttagggaagattatatagggagatgcatgcttgaaaagaaaatgggagcagaaggatagcatctaggctgccatcccatcttagtataattgctcattcaatattaattcaatatgtatttaccaagggtcttccatgtgccaggtattttgccaggtactacaaaaaaaatgagcagaaaacagttcctactttatttatttttttatttttgttaatttttaaaatttttattatactttaagttctgaggtacatgtgcagaacgtgcagttttgttacatagttatatacatgctacgatggtttgctgcacctatcaactcgtcacctacattaggtatttctcctaatactatccctcccctagccccccaccccccgacaggccctggtgtgtgatgctcccctccctatgtccatgtgttctcattgttcaacttccacttatgagtgagaacatgtggtgtttggttttctgttcttaggatagtttgctgagaatggtttccagcttcatccatgtccctgcaaaggacatgaacccaaccttttttaaggctgcatagtattccatggtgtctatgtgccacattttctttatccagtctattattgatggacatctgggtgggttccaattctttgctattgtgagtagtgtcgcagtaaacatacgtgtgcatgtgtctttacagcagaatgatttataatcctttgggtacatactcagtaacaggattgctaggtcaaatggtatttctagttctagatccttgaggaattgccactctgtcttccacaatggttgaactaattcaccctcccaccaacaatgtaaaagcattcctatttctccgcatcctctccagcattctgttgtttcttgactttttaatgactgccattctaactggtgtgagatggttatttcactgtggttttgatttgcatttctctaatgaccagtgatgatgagcatttttttcatatgcatgttggctgcataaatgtcttcttttgagaagtgtctgttcatatcctttgcccactttttgatggggttgtttttttcttgtaaatttaacagtttctatctttaaaagctcacagtcaagtgcagaaatcggggggggggagaggtgggggggtatcaacacagggtatctttttaaaatatgtcaatgaatatacaaacatacagtcaatataaaaaatctagagaactcaatgaaaaccacatgcagcttaaattctgtgaaacacgcctaaatattatggacttatgtgaagaacatatatgcacctatgtaaataataatagctgccttctttttgagacagggtctcgctctgttacccaggttggagtacaagtggtgcaatcatggctcaccacagcctcaacctcccaggctcaagcactcctccctcctgcctcagcctctcaagtagatgggatcacaggtgcacaccaccaggccaggctaattgtgtgtgtgtgtgtgtgcgcgcgcgcatgtgtgtgtgtgttttagagatgggggtctcattttgttgcccaggctggttttgaacttctagcctcaagtgatcctctcaccttggtctcccaaagtgctgggattacaggcatgagccatcatgcctggcagcccaacctgccattttttttagtactttttcggctaggcagaagaccttgcttatcagttcatttaatcctcataacaatcacatgaggcagctactactcatacttttatcccagatttacagaggataaactcagctctgtagttaaatgatttgtccacagccacattccaataggtggctaagcacaaactcaggttgtttgacgctagaacttaatgctacttgtgaccagtcaatcgccatgctacctcatacagaccctcactgcagaattacagaggagaggacactatttgtgcaattaaagacctctcggccaaggacagagcactgagactgtaaaggactaggagacactgatcactatggggaggggatatccctgcatgcaggacaacaggacccaggctagatacgggtaaatgcagatttcctctgctactgacactgtttagataccgtgagacattctgagtatgaagttgaagctagtagcaaactactcaaagattaaatacaaagtgacataaacattccttttaaaaaaaaattactctggtggcaatatggaactagctagagaagaatttaactgaaagcaaggaaataaagagatgtctacacttgattagttatttcctaacagctatgatgatgatgacagtgatgatgatggtgataacagaagctccaattttaacatgagggatatggaccacatttcccaggataagttttggccaaaggaaacgtagttgattttggcctttaaacggaagagggtccgggcgtggttgctcacgcctgtaatcccaacactttgggaagccgaggctggcagatggtttgaggtcaggagttcgagaccagcctggccaccacagtaaaaccccgtctctaccgaaaatataatacaaaaattagccaagtgtagtggcacatgcctttaatcccagctacttagaaggctgaggcaggagaatcgcttgaacctgggaggatgaagttgcaatgggccgagatcgtgccactgcactccagcctgggtgacagtgagactccatctcaaaaataaattaaattaaattaaattacattaaattaaattaaaaagggaagggggctatctcttcttccctacttcctccatcctcctacttggaatatagatgggatggagctgagatgctaagtacaaagctagaagcagcctggtccagatggctatacaaacccgaaactgtctacacccagactttaacttttaaagaaataagtttctatattgtttgagacacttaagtccctattactggaagccaaacctctatcctaacagagtgcactttatagtaatccgagtaagaactgataagggcctaaactatggcagtgactgtgaaaacagaggaaaaaaaagatgtgagaaaattttgagggaaaaaaaaacaacactttgaagtgaaggtgagagagaaaggagtgtggcaagtttctgacttgagcgaatggccaaggggaagaggtttgaatgagccagatatgcttgaacatgctgcattttcttttctttctttttttttgagacagggtcttactcctacttggaatatagatgggatggagctgagtggctaagtacaaagctagaagcagcctggtccagatggctatacaaacccgaaactgtctacacccagactttattcttctacaaccaaattcctcaaacacacaatctgaacagtagcagtgaaagggagtttaaggtgggggtgagggagaagggagtaatatggttttttagtaatatagtaatttacattttcaaaaatcttcagtgtttcactatcttaaatgaatatttattctgttgttcctctcatttctttcctcctgttaaaaaaatgacttttattaactccaatctcatgtggatttgggtttactcacgctaagatttggtaaaacatctgtctccaaagaaaaacaagtaacattcttttcaaattccctagaagaccgcgtaggacaagtatatgaagcatttataaaattcactccagtcccaactgctactttccactgtgaattaattttcatactattattgtccaagtttgttctgacacttgatttctctctgtaaatgttactagaattaacttaagctaggaaaaacaaaggacatagttttacctacaagcagatgtcattaactatacagatttttttttccacttaaaaacttgccacaaaaccacttattttctttaaacaagaatcttccattttaagttcttaaacctatattttaaattactataaggacagaatgtttgcttgaagaaaaaaaatagagagatgtcaagttcccaaacaatttgttttcttcaaatcatggtattagtgaaccttgtaaattattaatacagtacacaaaaagctacaatggatcaacgaaaaagatgacatttatagaatggtgtcatcagtggaaaatagccctttccagaaacaacacaaattctttctcctaactcagtctgttaggaaaatcaccaaaagcccttcaactgtctactcaataaacaatcagtaaataattgtttacttcccagtgtgtaaagcattctgctaaaaaagtagtagtctctctgttgaaaggacattttttccagtttcaaaagtttctctacggatagcatactgtgatatatttgggccatgctctcaaggaactctttttcagtctaaaaaaattagacaaatgtaaacggaaagaccttgaaattttcagaactccaattccttgtttcaaacatttctaggacacagtaaagaccaaagacaagcagcaaaatgtttcagagatgtaatctgaaggtctgatctctctgaaccagccccttagcatcttcgtcttcatgaagctatgcagtttcctctgttgtttcttaagcaatacctcattaagtgatttttttttcctaattaaaatctccctgaaggaagtaggtatactcccatactactactgagagtataaactgacacatctttctgcaaggcattttagcaatatacctcaaaactattcaaaatgttcttttggctttcagaaacagctggaaccagaagtttagataatgtttccagagctatgtctgtcttttcattttttgactatccttgcctcagcttgtgttcaatactcagagactctctaaacacagtaaggaaaacacacactggcagcctcaacttaatcacagtatcttaccttagtcatcctagtgggaaaagataggcgtgccagtttgttccaaaagaaaacacccaagctctaaccggtccagcttaaagtagagggtagggtaactaggactgaaactttccctggaaccgtagagaaaagaaggcatggttcccaaaggaagggatgccaggaagaaaattcacatatgtccatataaacatacatatccttgacccggcagttccatttctatgatgaaaatgtggcactattattgtgtaccagacactgttttactttacatgaaataactcatttaatcttcacaacatctctatgaggtagatactactatttactattatccaattttatgaatgcagaaactgagacagaaaaattaagtaacttgtctaaagccagaactactaggaggcaaaaccaagaatcaagctcagactatgtggctccatcccacactttatctatttttgtagaaatggggtcccactctgtcacctaggctagagtacagtagtgcaatcatagctcactggaacctcaaattcctggtttgaaatgatcctcccacctcagcctcccaacttgctgggattacaggagtgagccaccacatctagctcatcccacacttctaacttttctactactaaaatttactgcctctctatttgatcctgagaaattaaaaatcaatgcaaaaatctggctagaacaattcatcacagcactatttataacagcaaaaatttggaaataacaaaattatctaaccatgagattaactgataaatttatttactttaaattatatattaaaatgataaaaacattttgtagttaataaaaattgatgttatgttttatatatacaaagttgtccctggaataactcaagggttagatgcaccaacccctgtgcagtcaaaaatctacatataacttatgactccccaaaaaactttactactaatagcctactcttgaccagaagccttacagataacataaatggtagattaatacatattgttaatgtttatatgtattatataatgtattctacaataaagcagactagagaaaagaaaatgttattaataaaatcataagaaaacacagttactattaagtggaagcagatcatcacaaaggtcttcatccttattgtcctcatgttgagtaggctgaggaggaggaagaggaagggttattcttgctgtctcaagggtagcagaggcagaaaaaaatgtgtataagtggaccaacgcagttcaaatccatgttgttgaagagtcaactgtatatagaacatggaaagcttccaataacatgcagataagttttaaaaacacagcttatataaatggatagatgctataaacatgtttttaagaagtaaaatgaggacgggcgcggtggctcacgcctgtaatcccagcactttgggaggccgaggtaggcggatcacaagatcaggagattgagaccattgtggctaacacgctgaaaccccgtctctactaaaaaacggaaaaaagttagccaagcctggtggcgggggcctgtagtcccagctactggggaggctgaggcaggagaatggcgtgaacccgggaggcggaccttgcagtgagccaagattgtgccactgcactccagcctgggcgacagagcaagactctgtctcaaaaaaaaaaaaaaaaaaaaaaaaaaagtagtaaaattaattatacatatatacgtatatggatgcacacaaaaatctctggaaatacatatgttaaaatgtcagcagtatgccacttcttacccactggagtggttatgatcaaaaagacagaataacaagggagtagcaattgcaaaaccaaggacagcaatcttgattcttttttttttttttttttgaagttaagaattcttttaggttgtaatattttcatgttagtttttaatcatttacaatgttctgtgggtcacattttaaacatttttaaatatatgaaattctgtatttctttaagtacagccacaactacaaagcagagaaacgtaagaatacaaaaatcaaatctgcttcatttatatacacgatggggcagcctaatgcacatcataacattaacttttccaaagaagtttgctaagaatctgctcccataattagtgttaaaaataaagcaatcttcccatttagaaaaatcaagacatcagttgattaataaagcctattcttcctcccagcaatttgtactttctggtcttcatttaggaattataaattcatgagaaaagaacaaattttttatggaataaataacttccaggaacaacagtttataagtattcagttgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagcagttattactatttaaaattctattccttcacccagttttctcactcaagtagaaactcatgaatatctgtgattttggctataggaccaggccacaggaaagggctgaaatatctctaaaagttaggtaaaagtgttttcttgagacttgaaggcagtcattcatcactttgtgcttgaaggcattcctcagcaaacttctctcgagtcttcagagtaaagcacaggatctaggctcccggaaggggttacttccagctggaacacccaccagcagggcatccttgcaggcattctgcatacagtactgttgaagctctgcagctgcctgagagaccttgatcctctccacgccagcctccaacttgagctgctctaccaagagctgcagggcgctcgcgctagccccggaggacatggcggcggcgctgggctcctaggggctgcagcaatcttgattctttaggagaatgacaagtcgttcactgtaactaaggcttacttacttgctagttaccagttactcacacaatttccttaagtcttgcaacaatttcttcaataacttcaaacctcatgagccacaagtacaaacaaccctgggcaaacacggtgatttcaccataccatttctttaaaattattcattaaaaataaaaaataccaggccaggcacactggcttacgcctgtaatcccagcactaccaaagtgcgaactcaccagttcaagaccagccagggcaacacggcaaaaccccgtctctactaaaaatacaaaaattagccaggcatggtggcatgtgcctgtagtcccagctacttggaaggctgagattggcttgagcctgggaagcagaggctgcagtgggctgtgatgataccactgcactccagcctgggcaacagagccagaccttgtcttaaaataataataataataataacatgccgggcgcggtggctcccgcctgtaatcccagcactttgggaggcccaggtggacagatcacctgaggtcaagagttcgagagagcctggccaacatggtaaaacctcatctctactaataatacaaaaattagccaggcatggtggcacatgcctgtaatcctagctactgtggaggctgaggcaggacaattacttgaacctgggagacagaggttgcagtgagccaagatcgcgccactgcactccagcctgggtgacagagtgagactccgtctccgaaaaaaaaaataaataaataaataaataaatgaataaataaatccctggagtgagcctttttgtaacatgtaaatagaagaccgtttttagtttttgaattatttgataactaattattctgtttaattattagtagaaagaacagacccattgtacaaaagggagtcaaatgaaagggataggacaagctttcagaaatcattacttcaacttaattgcacaagttaaatcagcccaggatctagatgtttttgaactcgaattactgttttttaaaaaattgcttcaacattcatgcttactaagtaataaaaattgtatcattatttgttcagattaaaatcaaacagaaaagactacaatgaatcaattaaaaataaatatgagcacatgcttctaaagaacttatttttcttttagaagaaacagaaaatataaagcttatttagctgtgctttgatttgtgtatgaatgttatgaccatgtttctaggtaacatcaaagttttgtcaatgctaggaccatgggtggcaaacaggtacaaaaacaaagatgtcccttcccacactgctgtatgtgtgtatctcttcttcttgtgctaaattataatgtagcagaccagttagtgctgtagtttaaggccttggataagaaatggaatatctcctgaagcatagccctgatatcaatcatacagaaaagaaacagacatttggatggaaaactggaaccaggaaaatggacctcattagatagacctgacaggaataggttgtctgtcttgccaccatctagggcctagacttaaggaaacatgctgaaaggcaagatgaccttcatcatatgatggcagaccacaaactaggcagggtggaatccctttaggagactacagactgaaaaggaggaaactataccttgcaaaccagactactgacttaaaagttattctctggtttcattatctttttatttttaacctttagaaaagttttatttcactgctgcagctttgcctcagcaaataaaagtatgaatgatttggcagtgggagttaggccagaatgttaagaaaaagtggcactccatgagatcactggagaaatagaagaactggagctttgagttcaagccaatccttcccatacagaggcaggcgctccttccgctgtcaaccttggaggactagggtttcattttattaagagaattttaaagtttctgttcaggtacctagaactaaattcatcgtgacaaaatctgaagagatatgtactacattcaagagtcagcaggtttctgtagtgtttaaaattacagggttttgttttattaagggtttcattttattaagagaattagaaagtttcattttattaagagaattataaagtttcagccagagtagtcgctcacgcctataatcccatcactttgggaggccgaggcagacggatcacctgaggtcaggagttcaagaccagcctggccaacatagtgaaacactgtctctactaataatacaaaaatgagctgggagtggtggtgggcacctgtaatcccagctactcaggaggctgaggcaggagaatcgcttgaacctaggaggtggagattgcagtgagccgagattgtgccactgcactccagcctgggtgacagagcaagactccatctcaaaaaaaaaaaaaaaaaagaaagaattagaaagtttctgttcaagtacctagaaacaaattcattgtgataagatctgtagagctatgtactacattcaagagtctgcaagtttctgtaatgcttaaaatttttaacaagtatgtattactactgtaagtaaaacagtttagcacaggcacgtcagtggaagcaatatgcaaatgaatatgcagaagcatgcaccagaaatatgcagcagaaccaccaccatcctggttatgaattaaaagtaaaaactgggtagaaaaatagatgagcagagtttccaaatcacatggacacctgaactcaatagccagggagaaaggatcagtccagaaactaagtccataaggaggtaaagtcaaatgtgagtaaaacaaaacacagtttatagagaaaggagaccgagaaaagagagagaagagaaaaaaaagaaagagagaacaccagacaatcaatctgaaagcaaaggcaattaacctggttcctttgagagccagaacttttcccaaggtgttacccccatttgtgcttgtaactataaaagcacaatatggctttaaaagtctttagtggcaaaactctaaattctaagaccaaagtatatttgattctctgttggagcatcttgacgggtatgacacccatctccgcatgacttcctacttacacaagataaaactaaaatattttaagttatttgtaggatgtactgaatactgttttactattcgtgttcttagtttctacagtaaaatacatgtataccttacaaaactaaaattgctttttacttacatgacttttcattaacttgtattctacggtttaacattctttcattaatttaaaaaaaaaaaaaaaagtatcccaatcctcctcatttccaaggctgcaacagaatcttaaaacaaaacaaaaaaaccaatacactagaaggagtaaaacaaaaactgcttcttggggaacaattcattgtttcaaaataaatattttaacaaaaaattctataggctctatccatttttaatcatacctaccagtgagagtctactaggtgacttcttaagtcaacatttaagagtggggaaaaaaatgtgatgtttcattgctgtctctaaatttatgtggtattcataacactacagattacaacatgctatacaggtttcaacatttgaaaattctctggagttgtaatcatagttaaaagcaaagcattaaattcaagaagcttgaaaaaaagcaatgttttctgagaatgatcttttaacagtggtcaatttgcatagttttttactttctacaaaatactttactgatgaggggaaaaattattttctaccataattaggaatctggacttaacctgttatgccaaaaacagcaaccatactttgcaacaaaaaaaattttcaaaagcattttcaatcttcctgactaccaaagtttccactaccaaaagtgaaaacacttttaaaccttcctgtgtaacaagttttaaattttcttttatttatttgtatcaattttctcacctgtggctgccaaaatatcaagaatttcaactccagagaaggaggacagaagaaacacaatgtaaagtggttggcctagtaaaatagttggaaaaaaaactgttttggctgctctaatataatcttcatttattactcattagttctcttcttatggtcccaatattccagccaaattgagaatctactcactgtttatcaattcagtgcctttgccactactcatctccacctcccagtccccacaatgtatttatagacaaaagttttgatttaaagccagaaaactgggttcaagtttcatttaatcccttttaattccattcatgatcagtatgaacatggacaaattattttacctttatgcaccttcaaggataactcagtgtaaccatgaagagtcaatgcaataatgtgaacacactcaatttttttaaatgaatgaagattcaatctgatagtctctgcttgtaaaacaagtgtatagagaaatgtaggctgtgacactagatcccaagaaagtatctactggttgttatcaatataataatatggagaaaacaggtggcactagtaatttaaagttagaacaaggaacacaacacaaatttaagcctttcttaaaactgtgtaaaacaggctcggtacaatggctcatgcctgtaatatcagcactttgggaggccaaggcaggaggattccttgaggccaggggttccaggccagcctggtgaacatagggagaccccatctctacaaaaaactttaaaaagatagtgccactgcactcctgcctgggcaacagagcgagaccccatctcaaaaaaaaaaaaaaaaaaaaaaaaggcctgtaatctcagcactttgggaggccaaggcgggcagatcgcttgagcccgggagtttgagaccagcctaggcatcacaaagactctgtctctaaacaaacaaacaaaaaatcatgcaaagctatgtatctgtcttccaaggaattctgaattttctacagcttatttttcaatgaagtatttagagtggatgctgatttaacttgtaatgttgtgggagtgattcctatttcatatgtttggctttttgaataattttgtttgttgcaaaattgtttttaaaaaattaagcctatttagcactgttctatccagatagatttcctaatatttacaaactactattattataataactgcatgaaccattgtgtttgtggtgagttgaatagcgttgtccaaaaattcacgtccatcagaatctcataatgtgactttatttggaaacagggtctttgcagatatagttaaggatcttctgatgaaaattatcatggatttagggtgagccctaaatccaatgattagcatctttataaaagaaaagaaagggagatttggacacagtaacagagaatgcggccatgtgatgacagagaaagagatcagagttatgctaccaccaatcaaggagcccctggggccaccagatgctggaagagggaaaggaaggatccttccctaaatccttcagagagactgaggccctcctgtcaccttaacttcagacttctagtctccagaattgtgagagaatggtgtttgttttaaatcacgagtttgtagtaatttgttatggcaaccccaagaaactagcagagtgttggagcttaactaagcactattgtttaaacattttaaagtgagaattctctgtacttccctgcaatagtattaattttcccaaaagacccaaacttttttatcttcttagttaacaatctttttgttcctatactctagatcaatctatactgtttgaaattcatttaaacttaagcagttatgtgaaatatttccctaggcaaaattagtttttaattttctttcaagtaaacaatgaaacctacagctataactaaaaacttatgaaaaattttatgatgaagacattgataagtatatgggaaaataaaattatcaacttataaaagttatatttgccttcgcaatgtaaattatggtaataacaattttaaataaataacttttactcaataaacaactgcataaccaaccccaaaaatttcgagagctcagcaataataggatattaaatcttataatatttaatgatctcagttctgaccataataatgttttaaaattaagaaatactggcagggcgcagaggctcatgtctgtaatcccagcactttgggaggccaaggcgggtggattacctgaggtcaggagtttgagatcagtccggccaacatggtgaaaccctgtctctactaaaaatacaaaaatattagccgggcatggtggcaggcgcctgtaatcccagctacttgggaggttgaggcaggagaatagcttgaatcggggaggcagaggttgcagtgagctgagaccgagccccattgcactccagcctgggcaacaagaacgaaactccatctcaataaaaaaaaaaaaaaaagaaatacaattccagcaacacaatgatttaatcaatgccttcactttcctaacagtttttaataaaaatgatctttatcatattgggcataacaacctataatatacaaattaacctacaattaggaaataaaactattcaaaaagttatttcaaggctgggcgcaatggcttaatctcagcgctttgggtggccgaggtgaaagaatggctgaggccatgagtttgaggctgcagtgagctatgatcgcacttctgcaggcattccagcctgggcaacagaacaagacccggtcttgtattaaaaaaaaaaaaaaaaaaaaaaaagccaggcgtggtggctcatgcctgtaatctcagcactttgggaggctgaagtgggtggatcacctgatgtcaggagtttaagaccaacctggccaacatggtgaaaccccatctctactaaaaatacaaaaacttagccgggcatggtggcaggtgcctgtaatcccagctactagggagactgaggcaggagaattgcttgaacccgggagacggaggttgtagtgagctgaggtcgcaccattgcactccagcctgggcaacaagagcgagactccatctcaaaaaaaaaaaaaaaagttatttcaagaggttaggtctcttggaattcattatttagatactagtacctaaaatttaaaagcttaccctgaaacttcttggcacatatcaccactatcttttcctaatacctccctgtctgttagtgctaagtttacctgtagatttccagttctattatatgcctacgtgacctgtcacctcccacagtgtccttacacctgatcagtgatatgtttttttgtgtttgtttttgagacagagtctccctctgtcacccaggctggggtgcaatggcacaatctcagctcactgcaagctccacctcccgggttcaagtgattctactgcctcagcctcctgagtagctggaattacaggcacgcaccaccacgcctggctaattttggtattgttagtagagacaggggtttcaccatgtttgtcaggctggtctcgaacttctgacctcatgatccgcccacctcggcctcccaaagtgctgggattacaggcgtgagccaccacgcctggccgatcagtgatgttttaatgtgcatcattatagaacacagttttcagtatcgtttatctgaaatgtttggcatcagaattgtttcaggattcttttggatttttaagtatttgcattatacttactggttgagcatccctaattcaaaaatccgaaatccaaaatgctctaatgagcatttcctttgaatgtcatatcagtgctcaaaaagtttcagatttcagagtatttcagattttcagattagggatactcaacctgtatctccaagattaacgaaatgacaattttagtttccaaagtacatactctttagaagggatgactaagagctggactgatatatttgtatcccaaatacatgtgcttgagacccccacaacataaggaactttattcctatacatactatccccactttctccagcatcaactgttctcattccattgatttccactcttctacctttaaaatggtcacatctattccatacatttttaaaaactctcactggatcttactaagtctgcaatttaattcaacaaacatgttactgagagcaataataagccaggcaactctgggatacaaaaaatagtctttttaccctgaagaataggcattcaaagttttccaaccagatactcttacctctcaaaatcagattactgaaacaaatcatcttaatatgctgcctctacttcttattctttatcctactaaaattctgcaatatggtttacaatacaacattccagctgaaacaatctgggctaaaactacccttgatacagcatggtgtactgcagtatgggcatgagaaaacttctattacaagatttgccactcaatagctgtgtaactactcacaggtaacaactggggattgggggtgggggaggcgggcagccttcactggtttctccttacccaaaaattggacagatatagattatgtgtacagttaactttcggccctaaagttttatgaaatgcaaagcttttcattaactccttatctcactgatcgctatctgccacacctgacactaagaaatattccttcactttctatgacttttctgatctcgccttcttctgtgtatctggattcagattacccacatgaagcaataaactcagatttataatggtttaaacatgtaagattatagcctttcatgtcaaaataaataaataatttaaaaattcatattaaaataataaaataaatccagagggtagctatccaggtctgctatgacaatcccactataagtcattagggactcaggttctttctagctttttgctctgatatacctagggtttgggccttacctacttggcccaagatggctgctggggctgcagccttcatatcagaatgccagtcttaggaaaaagaaaagctaggaaggcataccctcatcctttaagaacacttataggatactgcattcatcatttccacttacatccaactgaccagaacttattcacatgtttatagctgtcagaaacttgaaacagtctctcttatgcatgtccacatgattattcaaaaccatcaaggagaagaatcgccatggaggagaaccaaatgtctcttccaaactctccaaacccttctgtggttccttttcttttacatcctcttaccaatagtgttccccaaagcttggttctcggtactttattcttctgtctctatgccaacttcttgggaacacctacacaatttcacaactctatatactctaatgactctcaagtctttgtacccagtccctacctgtcccatcttttgaagtctccacttggatagctgcaaaataaacaccattctatgtcaatcccacaaacacaaatgagtaactttaaaagaaaaacattctcaatcttccaatttaagtcataacatcacaagtacccccagacctccaggtctgcaattttgaagttgcctctgactcctctttccattttcaacaagccatgagttgcaggtcatattgaacttctaaaaagaaatgaaacaaactagactacatgaggtttatacagcatatgacttggggcatgtattcatcaaaatgactatggcccccacaactctactataatgttcgaaagttatcctaattattaaatccataagcctatttttagtccttattatacatgacattttcagcacatttgacatttgttatttcctcctccttgaaattctatatacccagggttttccatgataccatatcatgctatcttggttcttttgcaatacctctgactactcctatttagtttccaggctgccactgctttatctaccttttgaatattgatttttctctgagtacaattctgaggccactctttttttcactcttgcacatttcctaggcaatctcacatttttcttcatatttgacaatcagctggctactgacaattgccaagttaaatctcacttttctccttacctcctgactcacatgtctaaacacctaaatgacatctctaccttgattatagaccatcacctttcactcagcatttccttccctcatccaaattcatttcttctcctgaattccctatttgtatccatagcatcatgacacatattacctctcatccactctttctactttacccctcacattcattcattactaaattttactaatctgaactttcaaatttctctagcatccataccttccttgccatttccaccataaaaacgtttgagctttctcatactggtctttctcccttcagttcattgccatttgagtcacatttctatgttgtttcttgctttttaagagctaccatttttcaacagaccccaccatctatagagtcaaggctcaccatctatagagtcaaggctaaattctatagcctgatatacagagcttttcacaattgtcaacccactcaagcatcaaagcctacctcagtttccatctactttcacttctctccattcctgtaacaagacattcacatacacacatttttcctctatgcctataatctcctctatcctctttttcacatagcaaatgtttatgcataccatacaaattggtttaaatatcacctctcataagaagtcttctctttttccctcagtaaaatggatccatcctcttgaaataagcaatttatcattacttatttcaagaccttatccactaatgactaggttagggatagagttttaatctttactcatttgtatctagcctagcacttagcacaatgcctggaaagcaataaataactgtcaaatcagtgaatcccaaatggttcttgacaggtggcaacaaacagcaactagaaaataccaactacttcaggggagaaaactcaggctatgtattacaatggtttaacaataatcaattatcaatttttacaatgtctcaaaatgtggtatttcaggtgttatacataaatttacattctagcttgtctctctcatagtgcttaaataaaactgattaaatgcctaagaaacatgtcgaatgttctctaacatacttaaacagactgatatgaaaaaaaacaagaacttcaaataattaacataattgactccagatgaaataccaccaagatacatgaattataaatgtattaatggacagaagaaataaaaaaaagtaaaggcatataaaattaacacaggtagtcattatcaatttttctggacaaatctcagtaaaagaaagtaaaaacaataagaaaaatatagttggctaaataacttcacatattagaagctaatgatatttcttaattattctgccatagttcacaggcaaagtcagaaaaataaagtcttaatttcaaattatcaaaatcaaactatcataaaaatcagtggttttcaagctatgttctcctcagcataacagcactataagaacacaaaactggaaacaaggtccaatagtaaagtgactaagttaaaatgaaacactcaaatgatataataatacagccactggacattatgtttttctaaaattttataaaataacttatgtcattaatagcttttaaaaagatagtaagggtatctttctatcttccttatagctttttaaattaaacttttaattttgagatagttgcagatttacacacaattgtaagaattaatacagaaaccatataccctttacccagttccctccactggtgacgtcttgcaaaattaaattacaaaatcaccaccaggatatcatacaatccaccaatctcattcacatttcctcagttttacctatactcatttgtggttgtatgtgtgtatttagttctatgcaattttatcacacatgaagatatatgtatccaccacccagtcaaaatataaaacaattttatcaccacaaaaattcctcccaattacccttttataaccacatccacctcccaccctccttttttatagctttttcccccatattttcaacaactgtgtgttcattccatgtatcttccttaactacctatgatgtaccaggcacccttctttctatataattcaaatagcatgcattaactcttttttccagtttgtaaaagaaatttttcaaaagacaaggggtttttgcttttgtttttgagacgggatcttgttccattacccaggctggagtttgttccgttacccaggctggagtacaatggcaaaaacacagctcactgcagcctcgacctcctgggctcaagtaatgctcccacctcaacctcccaagcagctgggactacaggcatgcatcatcacacctggctaattcatttttatgtttttttaatttttagtagagacaaggtctcactatgttgcctagactggtctcaaattcctgggcacaagtgataacccacctcagcctcccaattacaggtgtgagccaactgcacccagctgacaagagttttttttttttaatccaattataaaatataaatatttaaaaattcaactgcaagtattgttaattgaaaagacactttaggaacaaaaataaagagtgtatcatttggccagtgaggtgactcacggctgtaatcccagtgctttgggaagttcaggcaaaaggactgcttgaggccaggagttcaacaccagcctgggtaacatggtgaaaccccatctctacaaaaaataagaaaattagccaggcatggtggcgtgcacctgtagtcccagctactcggcaggctgaggtgggaagatgaactgagcctgggagatcaaggcttcagtaaactgtgattgtgcgactgccttcctgcctggtcaacagagtgagacgaaaggaaaggaaaaagagaagggaaggcaagagaaggaagagaggggagaggggaggaaaaagggagggagggacagactttctagaattagaaaaaaaaaaaatctcaataatactgaggcaggagaataggacctggtggcagggaacctaaggacttcctagaactaaatcaaacagaaaaaccccaactttctacatccaagtaaataattgtgtaatttcccttcagctatgtcaggaaacatcctctttatttgcatagggtgtacaccaagtaaataactttgtaacttcacttcatcctcttcatttacataaggcatacactgcataaccaatgggaatcctctagagggtatttaaaccccagaaaattctgtaaccagcactctcaagctgcttgctcaagcccattcccaccctgtggagtgtactttcatttcaataaatctgtaattttctgtcattgctttgtttgtgcattttgtccaattctttcttcaaaacaccaagaacctggacaccctccaccaataacagtaagaagtcaaacaacccaataaaaaagagcacaaatttgatcagacactttacaaaaaaatacacaaatggcaacaagcacccgaaaaggtgttcagcattattagtcaccaggaaaacgcaaattaaaaccacaaatgaggtatgttaagagagtagatcttttttttggagaaaaaagcctgttgcccaggctggtctcaaactcctggactcaagcaatccacccacctcagcctcccatagtgatgggattacaggcgtgagctaccacgcccagccaaaagagattttaaatttcttcacataaacacgcacacgcacacacacacacacacacacacacacacggtaactatgtgaagtgatggatatgttaattaccttgactgtggtaatcatttcacaatgtatacataaaacatcacgctgtccaccataaatatatatgatttttatttgtaaattatatctcaataaagctagaggaagtttttgttctttggtttttttttttttgagacagtcttgctctgtcgccaggctgtagtgcagttgtgcgatctcggctcactgcgatctcggctcactgcaatctctgcctcctgagttcaagccattctcctgcctcagcctcccacgtagctgggattacaggtgcacgccaccacactcagctaatttttgtatttttaggagagacggggtttcaccatgttggccaggatggtctcgttctcctgacctcgtgatccacccaccttggcctcccaaagtggtgagattataagtgtgagccacggcacccagcctgtttttgttttttgtttttttgtctttttagtgaaggcaagtttattagagaagttaacaaaaaatggctactccacaggcagagcaaccaaaaatatttttaagtaataaattaaatttaaaaagaataactgaaactctcatacattgctagtgaaaatgtaaaatggcacagccaattagaaaagtttgtcagtctcacacaaataagacacttatgacctagcaattcttctcctacgtatttacccaagagaaataaaaacatgaacatgaaaacattcaaagatctgtatgcaaatgttcagaacaattatgttcaccatagcccaaaactagaaattcaagtgtccttcaactggtgaatggataaatcgtatcatactaagcaataaaaaggaacaactgccaataaattcaacatagataaatctcaactgtatgatcctaagtgaaaaaagttagacacaaaaaactgtatactatttatatgacattctagaaaagacaaaaacatacagacagaaaacagatcagtgactgccagatgctagaaagggaactgactacaaagaggcatgagagaactttttggaagcatgaaaatgttccctatctatctatctatctacctatttttagaaacagagtctcaatctgtcactcaggctggaatacagtagagtgatcatgactcactgcagcttcgaactcctaggttcaagcagtcctcccatcttagcatccgaagtagctggaactacagacatgtgtcaccacgccaggctatttttttttttcaaagatggggctcaccatgtggcacaggctggtctcaaactcctggtctaaagcaatcctccagcctcagcctcccaaagcattgccattatagatatgagccacagcggccagccctatatctatatcttgattgcagtagtggctacactaatgtatgtatttgtcaaaactcactgaaatgttcacttaaaagagtaaattttattgcatgtaatttatactttattagatattgttatgggatctttagggtgtcacttttctggccagaaacctgtggctggtggcacctctgcctgagttttgctcagacctgctagcctcattcccacccactcggccttgtaggctacactcagctcacgctaccagcctggatcccatgcctccaagaaagactggagtcaggcgtggagtggtgaggggtgtgtaagcgagcgtacagtctggccattgcccagtcagacatgtcagctgctgccacagggtgggcagctccaggtgctggcataagtgccagctctctgcgaggctgtggctggaccagttgcaccacaaacagcttccccggccggcaccggggaatgtagtggcactcagaagcttgaagatgccaggaaccacagggccccaaagaaggagtcacagccctagcttggggagctcccaggtctgggctcccagaagggccacagctcttatctcccttccttcacctgcaacatggtgagcaaggggcatgtttcagctctgcttgtgttagagctcttttaccctcaccattcaagggtcccaagttcttgttctgtgaccaggaagaatgaggtcctcagacaacaaatggagggtgagcaagacaaagaggaactttactgagcaatagaacagctcaaagacccacagtggacagctcttctctgtagcaagggtatcctgatgagtgttcagctcctagcagagagggtagctcctttatgcaggcaggtcaccccagcaagtattttctcagcagtgagagtggctcctctctgcagctggtcatcccaacaggtgttcagctatcagcagagagggcagctcctctctgcagctggttgtcctgctgtctgcagctctcagcagagaggtcctagactagaatgggtggctcctctctgcaggcagattgtcccatcatctcttcagctctcagcagagaggaggccctacagtgggaagctcctctctttaggcaggttgtcccatcatctctgcatctatcagcagagagggtaactcctctctgtaactggttgtcccatcatctctccatcctctgctctgctctgggctgagcctgcaacttttatgggcctcagaggggacaaagtgcacaccaattgtccataggtgggcccagaaaaggtaccacaagtcctcgctctagtccataggactggcagctgggcccccagtcttcaagccctccccggcctgaaggtggggcctcaccagagacctgcccccttccgccatccacgacgcccaggcttctcgcttcaaggggtacctgcaggccagcaccaaacctccctcaaacccctcccacggtgcttgtcagggcccaaagtccagagggggctgaggaggcaggggcccagtgtgtcagcgctgacctaagtgtgtacacacccgggggcgctgtgacagcaccctggcttggccccaaccccgctccgagattggagcaggcgcctccaagcctacaagggcaggagggatgccttccctggcccctgagagtgcaaagaggccttggtccacagccccagcttgggcagctgcagctgtgtggggtgggggggcctcctgctcgtggccccttagaacacagggagaactgggtccacagctctgacttgggtggctgcagcacacccaggagggcggggctgctgcctgctccagccaggtccgtggagtgtgcagccctagccatgccccctcgtagcctggagcaggggctccaggtcctcgctgggcccaggccagtatctagggcagaggtaacatctctacgagctccccctcacccagcttgtggccctgcctaggggggtgcctccaggagcagactgtgggccctgggcccagcccttgggagtgtcaggcctggcaatcaccctgatgcagggtggaccccagggatgcggccctaggcggccctgctcagagcctacccctgaggcacaggaacccggtgccctcggcagggtgggtgtggtgaccacgctgctggctgggtccctgaagcaggcactgctcccacttccggccccagacccccatatcacacctccagctccgcctcctcctcacaccctccccgcagcattggtgggcaagagtggtgacacagggccagggtcaggagctggggaggctccgggcctgagggcaggtcctgcccagaggcacaagggcgggggcagtacagtcggctgcctcagggatgcagggcacaggggacccaccagcatcattgctgctcccatagccgctcctgacaccaccgcccgcacctcttcgctgccatcaacatgacaaaagaagaattatcccaagttaaaaagttatacatttcactgttgacattctacaatttatacaagcttctggattgtattacttaaaaaattaatcttccttctccttcccttttcctgctgtgagaagagcagttgtcatggtacccctggggtggaggtggatccctggggtggagcttgtcatattgtcatagaccaagagagctagggaaggagtctgtgtggtaggggaagaggcaaacattttgcttcagagcccaagcattaaggcaggagggggaaactggcaaagggcactggggtacaacagagtgagaaggatatcttccaatggaagcaactcactggggtgtgtcagagtctgagtggggtacgaagtgtgtccaccgacagtggggagaccaacatgaggagtcataaccagagtgctggggagggtgtccctgtatggaagcatgctggtatggactcttagatccagactggggtagggggatggaggagatggaatgaagaatccaagtcccagcagggagaggagtagatggtagtgaagatgggagactgaacaataagtaaatacattcaggataacagaagccagatttctcactgtcagagaagaacgttacaatatgaaaaaggagaacactagaatagatcctggactatttgactgaaattggaggtatcagtatgaattcatagttttcaatatacagagataataaataaatatagatataaatgcatatgtatgtttatgcatacatacctatacttaccagccctgaccattaacaggacctggaaggagtaacagcccaacagcaataaacacactagccttgagatcttagcttctaaatgtcattctccactaaaaggaaccagggatccctaaatggctgattacagaaccaaggcatggaaagtacaagatgagccaggaacaggttcttgtgccaaaaagtacaaagttgttctcaaagagtgatggggatgtaccataagaacacagaagccagcttgtacaactctcattggccatataaagaacaatttgaacatcaaaataaataatgctatagtctgaatgtgtatgtcccctcccaaaattcgtatgttaaaatcctaacacccaaagtgatggtattatgaggtgaggcctttaggaagtgatcaggtcatggtggtggagtccttgtgaatgggattagttccctttttaaagagaccccagagagctcatttgacccttaagccatatgaggttaaagtgagaacatggctatgaggaagcatgtcctcaccagacactgaatctgtcagagtcttcatcttggatttctctgcctccagactgtgaaaaataaatttctattgtttataagccacccagtttgaggtatttttgttataacagcccgaatggactaaggcaaatagtaacagaatataatccgcgagctcccctttctggtctcacttcggctggatgtgcttagactctcctatttcccactcaagccagtgcttcgggcaggtgggctagtgactttttccgaatagactaaggcaaatagtaacagaatataatccactaaacacacacacacacacacacacacacacacacacacacacagactccatgtagatgtcaataaatgattaagagtttagtgaggaacaagatatttacatagtttcaaagtacatggcaaaaacaattaagtattaactttacagtggagaagcctcgcagatattacttatatcaagtaatcaaagtaaaaataaccaacaatgaaacaaagtgaaattgtgcaccacctgacaggatgcagtgagcatcacttctgtgatatccttcccacgtgcatattcgtatgtatctaatcatgaaggaacagacaatcccaaattgagggggcagcctacaaagtgactgacctgtaattgttaaatatgttaaggtcatgaaagtcaggagaagataaaggaaatgttccagattgagggagacaaaagagacataacatgaatgcaacacatattgctaaactggatccttttgccagtaaagagattactagcacaatcaacaaaacttgaaccagtctgagaactagatggagtactgtatcacaatccatttcctgttttggttattacactgtgatcatgtaggagaacattcttgtttgcagaaaatgcacattaaagtattctgggatgacagggcatcaggtcaacagcttcctctcaaattgttggggggcgggtagaattttttgtaccattcttgcaacttttttgcaagtctgttattgtttcaacattgttggccgggcgtggtggctcaagcctgtaatcccagcactttgggaggccgaggccggtggatcacgagatcaggagttcaagaccagcctggccaggatggtgaaatcccgtctctactacaaatacaaaaattagcgggcgtgttggcgggcgcctgtaaatcccagctactccggaggctgaggcagagaattgcttcaacccgggagacagaggttgcagtgagccaagatcgcaccactgcactccagcgtgggcaacagagcaaaactccgtctcaaaaaaaaaaaaaaaaaaaattgtttaaaagtggggagggggggaggcggaacaatgtcactaaaaactaaaggttaaaaaactgatttcccacacttaatcttgatagaaaagaaacatcagactatgccaaattactaggaaataaaattttggatccagaagtttaaacatttaaactttctctttaacaattgacctcaatcaggtcatgactggtgaaagagaaaagaacatgaaaggttcccactaaaggagaggaagttcttaggagaggaataatgaaagagagagtggaccaagagtgggtagaacaatggtattctgagctaccaatggctgtaaccatcaggaaaacacaatctcagcatctctgaaaaatgaaggggctgtagagctgatatctcaaattccttgcaaatgtgggactagaattgccctaaaatagaagtggtttcccagctcaatttgttattacattatgcttagctacatagtaatacaagagaatacaaatacagaaataaacgtgcatgaaccctgaattctcttaagttgtggaagtccgtcaattaaagtgtaaaatacaatgcatttgcccaattgttccttacgacgaaaattctgtgacaaataaaaagaacaatgaaaacacattaaagtgaaacaagatcaccttcagcggtcagctggctgtccttagttaaaagacaagtcatgtcactgtgaagtgaccgtcacatttgtcctgaaagaatagggagcatttcctagaaaggggtaaaagtgcaaagaatcctgtccccttccctggtaccacgcgttccttggggaggtcactaggcccccaacagcacaggggtgagttagcactggactctcagcacttcctttcggagaggacaaccccctgcgtcactggttactcactcaggatgcagggcagaagtttatccccgaggaacttagcacagttggctcccgccctcccagccttgcggtcctgggcccaatctcagggctctctctgccccgggtaccctgcagcctccagcgggagggtcgcgagaccccaactcgcctccggcccgcccagcgggtgcgcccaggggctgggcagacgcggcgtcttccctccccctaccgtcgtgccggcccccccacgcccaccgccaggctcagcccagccgagaaggccggacgccgaccgcccgctcctccgagactcggcctggccctccccgacgcccgtccccgacgcccggccccgcggagcccactggacagcggccggggggcggggaggcccgggggcggtgccgccccacacccttacctggcttctcgtggtcatagcctaccacgatgaagtagtcagccagccgggccatggccgccgccgccgcgctcgggaagcgggtccccgtcgccgccctcgccgccgccgcccacccggcccgggagggctcagcattttccctgcagcggcagtagcggcagcggcagcgcttcagccatgtttgacaacc

SEQ ID NO: 953 - DNA, 1938 bp, Homo sapiens
tgcaggccttggcttttattgagatcagagctgtgggctccccggcctctcagggaggcggtggcgggggggcctgattctgcactcagcccggcctcccaggtacaagtggctgactggagtctaagcaggctgcaagggcacggccatgcttctattgcttctgcccctccctcggaacctcctcctcctccctctccccatcacattctcccgaggcccaggcctgggcgctgggccgctgcctgggccaccccatgtggcagggccactgccgggggccgagcccctcctgctcaggctgcctcctcggccatcctgcccctcctgtacccagtcctggcactcgggatccctatggcctctccagggccccagagcgggttctcttgcacaagggacacatggcctcttcccaggtcccccaggacctcttgggcctgagcctagaaggactaggctgggggagggcacccttgtctgggtccatgctggaactggaagctgaggaaagaggagagaaaggagtcacttgagggacccaaggggaggctgggggggaggctggcagcccaccctggggtttccagaatccgatattcttgaaaacagaagggaggagggcaatgcttcctccttaacagaatccccaggggagggaggaggttgagggaacagaatggttcaagctggaaggaccctcatctaacctgaaccctcattttacaagtgagaaaactgaggcccagcaagggagacagattccaaggcccctcaccgagtgtggagctggggcagtcacccagccctccctcccagatcctccctttttctcgcaccgctttgtccctggtggattctccagaccccgcttagctgtgcgtgatgcagagatggggacagattcatcaagatcttggccttctggggcatggtgccactgtggaggcttgggagtggagaagggcccgcctgaggccccagcccaaccatcccctagggtcttcccccgtgcccagtcctgccttgacagagctcaccactgcttcccaggctgtccctgggcaatcgggcttccagaagggctgaacagaggctgttacgtgggcccagagtcccctgtggcaggtccagggcccaggctgtgccctcaggctgtggcaggcagcccccagccataagccggcccagccagtggctctcacactggccagtgggtggcgggtggctctccaggtagaggcccaggccccggaggtggcgcagccggaagttcttgggcttgcttccctgggcactggggcactgcggctgcggggaccccaggcccccctcgtagatgttggggggtgcgtcagggtggccggggcgtccttgggcctggctcactgcatctgcagaggagacagcgggagggtggtggccagccccccacagcagccatgaggggagggtgcagtcacatacctctgagaccagctcacatgatgggctacacccccagccaacctggcctcagtttacctgtgtgtcaaatagtctcagtccactgcctcccctgcccatgcccaagacacgactcctcttcccactcccaaccaacagggaggcctgggaagcctcgggccttggtactaagagtgctttcaggacctcaagtcctttctactaccctgttctgcccgctaccctaggaagagtattctggtccccacagagaaattgcacagtgggtttgagagaaagtggccagcccaggggctcatggcctggcccagtggccattcccctctcccaagcatacatgtccctgaggccacccctcggctttgggcccaggtggggacagaagcctatctctcttcctgccactcctccccacagcccggcaccttctcttatgtgcagctcagaaaatgcacagaccaaggcttccat

SEQ ID NO: 954 - DNA, 35623 bp, Homo sapiens
gccgtccaagggtccattggttgccatagagatcgtcgagcgctgggcctgtgatcgctgaggggcgagcagttgcgaccctgggctcctggggacctgagcgttatgtctttccgcgacctccgcagtaaggcagccccgcgcccctgtgacctgcgggtcttccagagattcagggctcccgcccgccgggtcccctgtgtaggcgatccctgaggcttgcgctgccggaggctcctttcgggcctctgcgcctcagggaccgcctgacccgcggctgcaacccggccgagcgtcccaggcccttcttcggccatttctagcgaggatggaaagttctctatctgccactggccgcgtgtggctcagaacgcttgaaatgtggctagtgcagatgaataactgaatttttaagtgtaatttatttctgtttgtgtagctgcatgccgctcttcgctaccgtattggaaaatgcatggagagtttagagactattttttgagttgggttagcttagcgcttagaaaaccgaacagcaggccgggcgcggtggctcacgcccgtaagcccaacactttgggaggccgaggcgggcgaatcacctgaggtcgggagttcgagaccagcctgaccaacatggagaaaccccgtctctactaaaattacaaaattagccgggggtggtggcgggcgcctgtaatcccagctactcgggagtctgaagcaggagaatcgctttggaggttgcggtgagccgagatcgggccattgcactccagcctaggcaacaagagcgaaacaacatctcaaaaaacaaaaaacaaaccaaaaaaaaaacaaccagcaacgaaaccgaggagaggaggctgggtgataatcattgcggctaacattttttgagttttaacgatctgccagggcccgctctgtgttatgcgcatttcattttaatcatctgaacaactctgtgccccctgtatttggtagtgaggaaacgggcacagagaggtcaggtaacttgggcaggtgatacaggcggtaggaggtggcactggggcttgaattcaggttgcctgaactccagacatcctgaactccatctgcatcctttctgcagggctggtaaggagaagggagctcgaattcctttgctaagagggtggggaagtggaagaacgaggctaagagtgttggttacggctgggcgcagtgggtcacgcctgtaatcccagccctttggaagaccgaggcaggcggatcacttaatttcaggagttctagactagcctagctaacatggcgaaaccctgccgctgctaaaaattcaaaaaattagccgggcatggtggcgcgcgtctgtagtcccaggtacttgggaagctgaggcaggagaattgcttgattccgggaggcagaggttgcagtgagccaagatggcaccactgcgctccaccctggccgacagagtgagactgtctttaaaaaaaaaaaaaaaaaaggaaaggtagatgatgattgccaatttggtgtgatccgaggggtctcttaaagccagttttctcgtccaattgttggtgcctgaaattttagcattagagattactccttttggttatgaattgctcttttctacaatgtaaaaatatctaggaagacgcattaccttttatccatgcagccactgagcaccagagtgtgaatcctgccctctggggtttgaaggtttttggtggccacacatcatgcaggatgactgtctcctcccacatagtttttagagaggccagcaccctgccgggggacgtagaatggggttttgttggggagcgcacacacggagatttcggaatattttgatcttaaattaatgctctgcagttgtgcagtgtatggtaaggatcttactcaaattagtgtctattttgacaataacaccgcagcattaacagaacttgactagtacctagtggtcaggagtatttaggcagtgccttactgtgtgaaggaaaggctgctgctttcttttctgttctttttttgagacagtcttgctctgtctcccaggctggagtgcagtggtgtgatcttagctcactgcaacctctgcctcccagcaattctcctgccccagcctccccagtaactggaattataggcgcccgccaccacactcacctaacttttgtatttttatttttattttattcttttctttttttgagatggagtctcgctctgtcacccaggctggagtgcagtgacgcgatctcggctcactgcaagctccgcctcctgggttcacgccattctcctgcctcagcctcctagtagctgggactacaggtgcccgccaccacacctggctaatttttttgtatttttagtagagacggggtttcaccgtgttagccaggatggtctcaatctcctgaccttgtgatccactcgcctcggcctcccagagtgctgggattacaggcgtgagccactgtgcccggcaacttttgtatttttagtagaggtggggtttcaccattttggtcaggctggtcttgaactcctgacctcaggtgatctaccctcctcggctcccaaagtgctgagattacaggcgtgaaccacccgcgcctggccttttttgtttttgtttttgagacagggtctcactctgtcacccaggctggagtgcagtcacatgatctgagcttactgcaacctcctgggcccaggtgatcgtcccacctcagcctgctgaatagctgagaccacaggcatgcaccaccacacccagttaattttttttttaatctctgtattcacatttcccagaaaacagttacagagtccctttgtgactttgctgtttcctgtgctcacactttctgtttcattgtcttgcgaagtctgacctgacttgcagtacctaggtaggttatttgtgaacattgatggaccattttgaacatggatcttcaagaagagtgcagacagaccttaaataaccaggaagcacactgaatgtagatcttggtacatatgggaactcaacaaatgtttgtggtgttcatttccaagtcctgctctcttgaaagcactaaggcttttcctgaggtgaccccaacctatggatcaacaagtattagtattactgtttcttaatctgttttatagtaaatctaaatatggttgtatagttcaaccactctatttaagatttctctaaatacaaggcgactgatctttaaaacttgtgttatttgggtcctatgtggtcactaaaattaaaaaaaaagacaactcagaaacatgaatgtcatcctacggattcccctcagaaataaccactgttaacattttaaaacactttttaatcagctgaatttgagtcaaaccactgttgacatttaaaaatactttttcttcatgacattttataaggacgggtgtttcttccttttagcagtaaaaagaaatgagatactaaagagagaaatgaaattcacagctaatccctcaattccattttcatgtatagccatctacttctcccattgaacttaaatatatgctttttaggtagcatttttggtattttaaattttatctcctttttgctttcccttgtagaaagttgacaaatagtccctaaagctgtcaataggttggaaataagaaggaaaagtaaagacaatatctaagttaataagtagttgctgtgtgatggggaactgaatgaattgtatttttccttggacagatttcacagagatgatgagagccctgggataccctcgacatatttctatggaaaatttccgtacacccaattttggacttgtatctgaagtgcttctctggcttgtgaaaaggttcgaacggcactttattgacatctaagagtgaatactgggttttatttattagtcatctagaaaacaggacacagctgtgatgctgcaaaagggaaagtttttggaatttgacagacccagctgtattctgttacaaaggagttgtggctgggcacagtggctcactgctctcatcccagcacttcataatctcagtcattcaagactagcctcatcaacatagcaagaccctgtctccatacacaaaagaacaattagctgagcctgggtggtacacactcatagttccagcgactcaggaggctgaggcaggaggatcacttgatcccaggagtttgaggctgcagtgccactgatcatgctattgcacaccagcccgggcagattgagactgtgtctcaaaaaacaaaatcaggccgggcgcagtggctcacgcctgtaatcccagcactttgggaggccgaggcgggtggatcacgaggtcaggagatcaagaccatcctggctaacacggtgaaaccccatctctattaaaaacacaaaaaattagccaggcgtggtggcgggcgcctgtggtcccagctactcaggaggctgaggcaggagaatggagtgaacccgggaggcggagcatgcagtgagccgaagtgtgcagtgagccgagatagcgccactgcagttcagcctgggtgaaagagcgagactccgtctcaaaaaaaaaaaaaaaaaaaaaaaatcagtggagtttaaagaatgctgtgggagtgggaaatataccaggaagtcgtgaaaggagacgactattcctcagtaggatgctgggccaggctgctcttcagcccctcatggcagagtgacaggggcctttttgcacattctgatcagtacactggattagaaataatggagatttctttttctgtgaaaaaattgaatatgttatatgattcagggttggcagctttttctgttaaggaccagataatattttaccttttgctaaatataaaattcataagatctctattgcgtctcttctttttgttaaaatgtaaaaacagttcttagcttgcaggctgtacaggtcggaggctgcagtctgctgacccctggtttcaataccttgaagaaaataacttcaccaactctgctgctgcttagagctgactaatcggccctagcactgatctctgagtcaagggctgtcagccagggtagcagttctgattagcttcatgacatggtgagatctgagagagatttaattttataagctgagatccacatttagtttttgaaatctgtttttcttaggtggggatttgctcccttggtatttggttttgcttttgaagtttgccttgatctcactctcccacttggggacttggagagcgttgtgttccagacccgctgtcctctcagttgcccacattctctttagtagactttctccttggttaacccgtgctctctcctcttacctctcttgatagatatgagccccagactgacatcccgcctgacgtggatactgaacaggaccgagttttcttcattaaggcaattgcccagttcatggttagtggacacttattttgtggagttgtaaaattaaataaactagaaaggatgactccttgttagggcgactttcaaactgtgtaattgagtttttctttctttttttttgagatggagtctcattctctcgcccaggccggagtgcagtggcacaatcttggctcactgcaacctccgtctcctcgggggttctcctgtctcagcctcccgagtagctaggattagaggcacacgccaccacacctggctaatttttgcatttttagtagagactgggtttcaccatgttggctaggctggtctcaaactcccgacctcaagtaatccaccctccttggcctcccaaagtgctggaattacagatgtgagccaccacgcgcctggcctgagtttgctttctaaaaccattccattgctgggtttctgtggcaccatttcaccagcgaagttctttttgtttgtcttttaattcattatttgttaagaattttgtttatgccaggtgtggtggctcacgcctgtaatcccagcactttggaaggccgaggtgggcggatcacgaggtcaggagattgagactatcctggctagcagggtgaaaccccgtctccagtaaaaatacaaaaaattagttggatgtggtggcgggcacctgtagtcccagctactcgggaggctgaggcaggagaatggtgtgaacctgggaggcagagcttgcagtgagccgagatcacgccactgcactccagcctgggcaacagagcaagactctgtcttaaaaaaaaaaaaaaagaattttatttatttatttttgaatagataacatatttcatggctcacaaattgaaagtaggctgggcgtggttgttcatgcctgtaatcctagcactttggcaggccaaggtgggaggatagcttgagtccaggagtttgagaacagcctgggtgatgtagtgagatcctgtctctacaaaaaataaatttaaaaaaaattagatgggcctggtgacacgtgcctgtagtctcaggtgcttgggaggctgaggtgggaggattgcttgagcccgggaggttgaggctgcagtgagccgggatcatgtcattgcactccagcccaggtgacagagtgagaccctatctcaaaaaaaaaaaaaaaattaaaaacattatgaaacaaaatggagtaaaatgactttttaccctatctgccctgggccaagttccattccaaataaccactattttaaatctcttccagagtttgtgtgtgtgtgtgtgtgtgtgtgtgtgtgtgtgtgtgcaaataaaaatatatatttttcctttgttttacacaaatggtactgtattctacttgatgtacttactgtacactacaagatgtttagcatcttgctttacttaatggtatattttagagaactttccaaatacatatagaatttcctcattctgtttacgcctgagtggtattgcttgcatggatttgccataatttatgtaatttatataggtaggcttttaggttgtctgaagctttgctctttggaacagtgctgtaacaaataacctgtacatctcattttgtttgtgtttgagtgtgtccctagaataagttcttagatttgggattgctgggtcaaaagatatgtgcatttgtaattttgatgtcttttaccaaattgctctccatcaagattgtcccagtttatacaaccactcacaatgtttgagtcacttgaatgctttgcttttattaggttatatcccagttgtcagcagaggcattttcaactcacctacatgggatttagtttagacattacatggaaagggccttcaactttttttttttttggtctaaaaataggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaaggtaaggacaacaaaagccttgtagtgggcgatggagcgttgatttcttgagctctgaagtggaaggagtctgctacagctccgctgcttttcttcctcctcagctgagggcagtttgtcagttttgtgctcatcagcatttggataaagtcaaagtcacaatccactaattcaactatttattaaaagcttagtatttgtcaggtagcattcaagcgctgaggatacagttgtgaacaaaaaggacaaaaatcgtgtgtttattctcttcagttaggggagtcagactgtgaacaataagaggtgtggaaggccagatgcagtgcaggctgtggagaataataagctgggatggggatggatgctgcccagagtgatcttaaatcgggtgatcaggaaggcctcatggattggatggtgtttccagcagagatccaagggagggaaagagtgagttgtgcgggtggcgggtggcgtcagggtgtctcaggatgataatttgttttgggctgggtgcagtgactcactcctgtaagccaaacactttgggaggccgaggtgggaggatcctttgatgccaagagttccagaccaacctgggcaacatagtgagacgccatttttaccaaaaaaaagaaaaaaattagctaggcgtggtggtacacacctgtggtcccagctgcccaggaggctgaggtgggaagatctcttgagcccaggcagtcaagccatgttcatggcactgcgctcccgcctaggcaacagaacgagaccttgtctggggggaagaaaaaaaatgtgttttgtgtgtttgaggaaaagcaaggaggccgtgtgatgagggttgggattgacagaccctctggcgcctgggaagcccctggaaagcctttgtctttgcctctaaggtgggaatcgttgggatccaagcggaaccttctgtgcttatttcccgtccaaagggttgctctggctgctgagccgccatcagaccgaagcaggcggcagggctggaagcagcgagcctgtttggagagtgaggggtgaccgtggctttgagcagagtgctggtgggacaggtgccgtcaggtgtcagggagcgaccacagcagcaagccagaaataaaggttaagccgttactctgaggcccaaggcctcagagcaggagacctaggaatgaaggccccggggctgggagtgcacctaagagtgtggccacgcagggtacgtgaaaccacagtgcactggctgagctccaagtctgctgcagggaagaaagcttcccctgtgaggcctgctaggtgaggccttgtcatggtctatagttgggcttgaaaagccacacacagcttttttgttttgtttttgttttgttttgagacggagtttcagtctgtggcccaggctggagtgcaatggcacgatcttggctcgctgcgcctctgcctcccaggttcaagagattcttctgcctcagcctcctaagtagctgggattacaggtacacaccaccatgcccagctaattttttttttttttttttgagatggagtttcactcttgttgcccaggctggagtgcaatggcacaatctcagctcactgcaacctctgcctcccaggttcaagtgattcttctgcctcagcctcctgagtagctgagattacaggcatgcgccaccacacccagctaattttttacttgtagtagagtcagggtttctccatgttggtcaggctagtctcgaactcctgacctcaggtgatctgcccgcctcagcctcccaaagtgctaggattacaggcgtgagccaccgcacccggctttgtatttttttttttttttttagcagagatggggtttcaccatgttggccagctagtctcaaactcctgacctcaggtgatctgcctgcctcggcctcccgtagtgctgggattataggcgtgagccaccgcgcctgtcctcacatgtgggtttttaaccaggagcgacactcgtcagcaagagaagtgtctagagattggggcatattttgatggtagatctcacgggatgaggcatgggttgagagtaagtcaggtgctacaggccgggtcttggggcagccgtgcggcagagcttgcagagctcatgggtgtgttccgcctctgtgctgtactctacgggaaccactggccacatgtggcaagcacaactgaggaactgagttgagttctgcattttctttaattcttaagtaatttaagtgaaaatggccacatgtggctattggttactatattagacatcactgctctgaagttttttgtgtgagcccctggaaggatgaagttgccatgtactgaagcagagaaggttctgcacatgctccatttgccacgccgattggctgtccaggtggagatggtgcacaggtagctggtatgtgaaactagagcccagggaaagcccaggctggagctgggagctggggagcaatcagcacacagatggtattaaagccttgagggtaggagcagagccagcagaaaagacggggggtccaggaatgaaactctgactcgctccacttttgagaagcagagaaggtgacagactcctgcaaagaagtttggggatgtgctgctcggaagggaagaaaagcagctagagccagagcaggctggatcctggaggactaaggaagagggaagcaagctatcaaagccatcagctgcaaatgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttctgcctataatcccaacactttgggaggctgaggtcggagggtcacttgaggccaggagttagagagcagcctgggtaacatagccaagaccctgtctctattaaaaaacatctgttgctgaggtttctgtttttgttattttccttccagattgcagatttgaaggcagccaggcagcttgcgtctgaaatcacctccaaaggagcatctctgtatgacttgctcggcatggaagtagagttgagggtaagcattccagtacttccttaaccatgcagattttctcttcaaggttttctttttcaattctgtttctcccttttcagttctgatttaatgaaatacacctggttgaatgagctaatgtgtggaaaggtgatagaggatattagctgtccttcctgcttctggtgggcactggtctagctttatttatttatttatttatttttatttatttatttttgagacggagtctcgctgtgttgcccaggctggagtgcagtggcgcaatctcgtctcactgcaagctccgcctcccaggttcacgccattctcctgcctcagcctcccaagtagctgggactacaggtgcctgccaccacacccggctaattttttgtatttttagtagagacagggtttcaccgtgttagccaggatggtctcaatctcctgacctcgtgatctgcctgccttggcctcccaaagtgctgggattaccggtgtgagccaccgcgcccggcactggtctacctttaacttcttgtttaggagtggcagctccatggcatgtgactgagctgtccttgttgtgcccactggcagactttattgatcatgatgtttttttctggtgtactctgcttcagcattttctcaaaaatgatcttctgagcttgcagttccccgaccttgctgcccagtgcaaacacctggggacctctaaagacttctgaagcctggctttcactctggggtccttgttatggaatgtgacctgggcattgggagttttcagattctcccgggtgattctaacagcagtttgggaccagcaatcttggcatcacttccagtcagctgaagttgatgttgcagtggagactgatttgatttgcaatccttattccagccaatgccagccaagaagtatgtgccatcacctacatttaagtagctgtttaagactggagtggtgtttattttttatttttttaattttgttattttttttgagacagtctcactctgttgcccaggctggagtgcggtggctcaatctcggctcactaaaacctccgcctcccaggttcaggtgattctccttcctcagcctcctgagtagctgcaattacagatatgtgtcaccacacccggctaatttttgtatttttagtagagatggggtttcatcatgttggccaggttggtctcaaactcctgatctcaagtgattcgccttcctcggcctcccaaagtgctgggattacaggcatgagccactgcgtctggcctagagtggagtagtgtttaatccttacctgtaaagatttatggcatttgaagcatatgtgctcaatctaatgctttaaaactaaatgaatttctttcattcacttcctagcaagagtgccagccatggcttctctctctcactgccttgcctgtgttctggcataccctgggagcaaactggaagtggaagtctggggaagagggacttaggtgctagattgctatgtctgctcatcatatattgacccggcagttgccacctgatgaagtgtggttggcagaatgaaactgccactgacatctgctagctaattcagatgatgagtaaggtacctccaggctttcccctgttctgtttgtagtgcagtggtgtacatatgtctgtacatgtccctaagagactcagagacaggagctggccacttgctgattgccactagagctgtggcatcattgtgagacttcatttccatcccacggggtctctttcaacaccatcctgtaaagaatgatgaagtaaccagtggctgaaactgttcccaaggaaaccatgagaccctgaatgtagtacttgtcaaattctgtgtgtagtcatgatccgaggaagagcgcctatccagtgtttgtttttctttcattcagtaaacatttactgaggtgcagcctcagccacaggcaaggcactgagctctgcctccttgactaagtcctcaccctgccctcagccattcccaccaggtgcaccgtggatgaaaggaagcacaagacgagttttgacacagtgcttcaggaaccttgtcttactttgttcaggctgccgtcccaaaacacaataagctgagtgacttataaataacagatttgtttctcacagttctggagattgggaagttctagatgaaagcactagcagcttcagtgtctggcgagggcttgttccccacagatggtgccttgttgctgagtcctcacatggcagcaggggtgagggatctccccagggtttctcttaggagctaatcacctcctaacatcatcacattgtggtttcgagtttcaacataggaattttggggtcacacaaacattgtctatagtaaacctcataactatatccacattacaatcccatgtctcagaagttttcagcactgatatgatagtcacagatgtctcccttgataggttaatggttcatgctaggggcagggccatggtcactgttcttatcggttgcgtttgttagtgataggcaactgagagggacttcatgctaagaaagatgcttagtttgggagtcacctggacagaatgcaggtaaagaagcaaattggggctgggcatagtgactcatgcctgtgatcctagcactgtgggagaccaaggaacgtggatcacttgagcctaggagtttgagcaacatagtgagaccctatctctatttaaaaaaaaaaaaaagaagcagcagcaaatttgggagaaaagataatggatgctaagttcagttttgctcatagagttggggtcacctaggcctctggctgaaaaggaggaccttgagctctggagagagctgggtaggcactcagataatggaagacattataggaggtgatggtggcagtgtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttggtaagatgactttgcttttatataatgttttttatgcctgggattcaaaaatactgatttcttgcccatacaagacagaacaagctaggcttagtaacaagggatgtgttagtggggaaatgaaaaactcaagaggacattcgagcttacctaggtcacttactatcatttttttcccctcgttataaataaaaacagcttctcatgttattaaaaattgatcagtttcagtaatttgataattatcagttattcaataattttaataaataatgctctattttattttgtttaaccaattcctcactgcttagtatttaaatgatttcagggttttctaaattccagacagcactgtaataagtagaaggatcactattgtttactgctcgctcacatcagttatcctctcatctaaagcagtcagttggaaggcagatcatgagggtgactctagactcagattgcttgggtttgaattccactgtgtgatattaggcaagttacttaccctctctgtgcctcattttcctcatctgtaaaatggcaagaactgcattcccaactgtgtggggtccttataaacatgaatcacgacagggcatatcaagcctcgtctctgatgcacaattgataatcagtcatcactggtgatttattttactcagtagacacggatgagggcccctgtgtacattcagagtaggcataaaacaagaatttgctatgagttgtacaaaattctaaaaatcataggtttttaaaaatatgtaattcttttgtcattaaacagtaatacctgctgggcagcccagcctagggagtcagagcctcacagcgggagaagggcaccacagccctggtgggagattggtgacagataggcagatgggtcagataagtaaaaatatggcaaggataatggagccacgttcctcactgttggagaaaaaagtcacaaaaatgtcacaaaaatggaaagagagaaaattagggtgaacttgaaattggaggtgttggttaaacgcatagttttcaatatatagataggtataggaataaattttgatatacatgtatgcacatttaaggaattacgtatatatgtatataaatgttttatttatatacatacacgtagagacacccacactcatacatttcttagctctgagcacacgtagcacctggcttaatgccattctccactaaaaggaaccaggactcttaggggaaaatggctaattccagagttgggcaggagaagtacgagaaagtaaggaagagttcaaaggaggaaagggaactattggaagcatgcagaagccaacttaagtgggcttctcctggccaaagtaaggacaacttaagcatcaaaataaataagttagaataattaattttatggtataatagaatgaaataggaaaccatgagttttcactggcataaaaaaataaatgaatattggaggctgaggaggagcaggtcattcacacagattcgaagtaactttccacaaagtactttttttttcttttttttttttttgagacggagtcttgctctgttgcccaggctggagtacagtggcacaacctcggctcattgcaacctctgcctcccaggttcaagtgattctcctgagtagctgggattactggcgcacaccactacacccagctaattattgtatttttgttttattttatttatttatttgtttatttttttagacgaagtcttgctatgtcacccaggctgaagtgcagtagcgccatctcagctcactgcaatctctgcctcctgggttcgagcaattctcgtgcctcaacctcccaaatagctggaagtacaggcatgcgccaccacgcccagctaatttttgtttttttttttagtagagatggagttttgccatgtttggccaggcttgtctcaaactcctgacttcaggtgatccgcccgccttgacctctcaaagtgctgggattacaggcatgaggcattgtgcctggcccgcagagtacttattaattacagaggggaaaagagtcacttctcagggagaagcctgccagtcacccccttaatcaagagatcaaagtgaacatcatcgttacagaacaaatcaaaatcatgcacgcctggtaggatgcagtcacttctgagtattcctgccaacgatgcatatctgactctaatgagacaaagccggattgaggggcattctacagattaaccagcctgtatgctcccagagtgaaaaggttctgaaagtcaaggaaagctgagggggcatttcagactgagggaggctgtggagatgtgataactggacacataggcagctcctatctgctgttggggacttcactgggacaagtggggacagtggagtggggctggagttagacggtggtagtgtgttagtgctggcttcctgttttgatgattgtattgtggggatgtaggagaaagtccttatttgtaggaaatacacgctaaagtattcagggtattggaacgtctggtcagcaacttactgtcacctaggttgggaaaaacgctttgtgttgtacaacaggttttccgtaaatttttgattgtttctaaatttaaaaattaaaaaaaaattattatacctcttatccttgccagtgttctaactgaatcaggtgaacacggcatgaatgtgcccttagcactaatatgttaaaagtagaacacccaagagaggacagggttcatttcttggtagacatctcttaagactcctttcattgttagaaaatatctgtgatgtttgatcattctaaaaacaaccaaaacaacatgggtacttaaaagggtttggggagtacaggccatttatttcagaaaccagggaaaattgcttgtgtttacacagctgttttgcattgtggatctttcttgtttgaggaacagatatgtttaaggtgggataaatttactaggttttaatctgactttggttcgaggaaacagttgccattaactgaagttgtttagaaaggagacccacctttcttcctgtgagggtgaactcgcatttctcctgggggctctaaggcacttgcagcaaatcgatgataagggtctgattattttcatgaaagtatcttagaagtggctagtgtacttagaccaaaaaaattagaccataaacgcattgtcagtaacagtggctggttccaaaacacaccatgcctgagagttgtggagagtgtctgggcttcgtaggccatttctctgtggagcccatagcttttcagagacttgcaggaaaacagagtaaccccttcgtgggatgctacacataggcaaagagctggaggggaagccccaccttggccaccaggaacttaatgcagggctggaaagccagaaccctggggggcagttccacgctcagctgggtggcagtccagattcctcataaagagattggagcctgaaccccaggcatgtgatccagccagccaccggacaagacgcatgtgaagacggcgcactaccagtgactctacctgcttcaaatgaaccttctcttaggatagggagacttgtgtcaccgtcagtgggcccgtgtcccccttcccttctttactcagcctctgttgcccaagggcctctgtccaactgttgccctggaccccttccagagctggtgcacaccagtgtggccattgccactgtgggaactgctttcgtactgtcttcagagtggtttctcctcgtttttagtctgtagtcaagcttctgttgccagggagagggaagaggaccttctctcaatcccagcaggcagtgggttagggctgggaccagctgtttctttctctcccctcctagtagagcagtacttggtgtgtgtgggtattctgtaagtcgggtgtttgtaactaggggcatggcccgaatgataaaaaggcagactgaccgtccagagtgatgtgcaccttgttctaaccgagtgagccagagaaaagactgcaggcctctccaccttgaccaggacactcttctttgcatcttcacttctttccctgggtagaaatgcctgcttttcatggggaaaaaaaaagagatacctttttctggacctgtgtgacattctccctggaactagtgggttaagtgagtcattgcttggggaagtgtctatttgtttgcttttgtgtttgttgagcataatgttgctatgcctgaagagttgcaaaattcttctaagaattaggatggctgtttttattgccaccttgtctcattatttcccattaaatatagacacaggttcagaagactaaagacctgctcaataatgtggcctctgatgaagctaatttagaagccaaaatcgaaaagagaaaattagaactggaaagaaatcggaagcgactagagactctgcagagtgtcaggtagatatgaacacttggagaatgagtagaaagatgtcctggaaagttcaaacaaactgggcgtggtggctcatgtctgaaatctcagctactcatgaagctggggcggggggttctcttgagcccaggagtttgagaccagcctgggcagcataatgaaaccccatctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaaaaagaaaaagttcagcaaaccagtatagatttttatggttttttttgtttttgttttttttttttgagttggagtttcgctcttgttgccgaggctggagtgcaatggcgcgatcccggctcactgcaaactctgcctcccggattcaagcgattctcctgcctcagcctctcaagtagctgggattacaggcggccgccaccacgcccagctaatttttgtatttttagtagagacggagtttcaccatgttggccaggctggtcttgaactcctgaccttgtgatccacctgccttggcctcccaaagtgctgggattacaggcatgagtcatcatcacgcctggcctttttaaaaaattttttatcgtttaaaaacctctttagactgggcacagtgattcacgtctataatcccagcactttgagaggccaaggcgggcagatcgcttgaactcaggggttcaagaccagcctgggcaatatggcgaaaccccatctctacaaaaaaaaaatataaaaaatagctgggcatagtggcacatgtctgtagtcccagctacttgggggcctgagacaggaggatcacctgagcccaggcgttcgatgctgcagtaagccatgatcacaccactgcactgtagcctgggtgacaaagtgagaccctgtctcaacaaacaaaaaaaaaccaccagccttaattcgtaacaacctgtggtcccctttttagaggattgctttaaatttataatatcctgacagtagaacattattattattattattatttcttttgagatggagtctctctgtgttgcctaggctggagtgcagtggcgcaatctcggctcactgcaacctccacctcccaggttcaagcagttctcctgcctcagccacccgagtagctgggattacaggcatgtgccaccacgcctggctaatgtttgtatttttagtagagacgaggtttcaccatgttggccaggctggtctgaaactcctgacctcagttgatccacccgcctcagtctcccaaagtgctgggattacaggcgtgcgccaccgcacccggccaacagtagaacattatacccaaataagataataatatatatatttattgatttggagagatgtgtctggtatgtgatttttttgcctttagagatggggtctcaatgtgtcacccaggctggagggctggagtgccacggcaaggtcagaggatcctcactcactgcagccttgaactccagggctcaatcctcctcctacttcagcctcccaaagtgctagggttacaggtgtgagccgatgcacccagcctgatcatttttaactctattgagattacggtatattgaaatgaaataaagattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctgttcagccattccttctggtgtgttattttgtactgggtgacaggtcattttgttaatatcattgtgaaaaaaatatcagtacatgttttttctccctggtcagtctgaggattgctcatgtaatgtgtttgttttgctggcagtgtacactggactccagggttgtcaaatctttgatgtcatatttcatcaggtttggtcagttaagagaacagacagggccgacatgaggcctgtgtggctgcgtaagaccctgtgccgacatggggcctgtgcttgctttcaggccctgttgtcactgtcttgaaattcataataatttttaagtgcattttattttccactgatcccaaaaattatgtagctggtctcgagtgcagatttaaaagcttgcttggctttgggaggccaagacgagcggatcacttgaggtcaggagtttgagaccagcctggccaacatggtgaaacccctcctctcataaaaatacaaaaaattagccgggtgtggtcgtacacacctgtagtcccagctactcggcaggctgagacaggagaatcgtttgaacatgggaggaagaggttgcagtgagccaagatcgtgccactgtactccagcctggacaacagagcaagatcccatctccaaaaataagaaaataaagcttgcttagtcagttcacataaagattttcaaggcaaggtgcgatggcttatacttgtaatcccagcactttgggaggcttaggcaggaggatcactggagcccaggagtctgagaccagtttgggcagcataatgagaccctgtctctacaaagaagtaaaaataaattagctggacatggtgttacacacctgttgtctcagctacttgggaggctgagatggaaggattgcttgagcctgggagtttgaagttggagtgagccatgatcatgccactgcactccagctcggttgacagagcaagaccctgtctcaaaaagaaaaaaaaaaagggccgggcgcggtggctcacgcctgtaatcccagcactttgggaggccacagctggtggaccacgaggtcaggagtttgaaatcagcttgtccaacatggtgaaaccccgtctactaaaaatacaaaatttatctggtatggtggcgggcacctgtaatcccagctacttgggaggctaaggcaggagaattgcttgaacccaggaggcagaggttgcagtgagccgagattgcgccactgcactctagcctgggcgacagagcaagacaccatctcaaaaaaaaaaaaaaaaaaaaaaaaagaaagagattttcaagtcctggttaattgaatcaccagaatagctcattggagattgttttgtaaagaggaatggcagtttatttattgattgtgggaaataaatgtgtggccttgagcctgaccaaccatcttacaggttcctctcatccctgtgggtaaggccatttaggaaaagagtgttttagacccgagcatgagttgataaatgtggaatttagagcaaaggaaattgaaccaagttgtgatcagtttttgaattgccctatccttaacctgagaatggtcatttagactccattttcatgatgaaattggtctgcagtctccctttctcatgcccttgacagcttttggtattaaggttatgctaggcttcttacaatactgagcatttgagtttggcagagctattttgttgtccaggagggctaactgggagtacctaacgcatccgtgtggacacatgtcatcttgacgaggaattcattgctagcattactctgtggcagaggcaggccatggagaaatggtacgggacaggcacatttcgagggcactagaaagagcttggagtttagaacattttaaacattgggtacctgggaaagaacagtcaagggcagtgaaaagaaacgttggccatttttttgtattatctggggccacctctgggttcagagaacaaaccaaacagtatgcctcagagtggcaggtaggtggcccaggaaacttcccagggagcccctctaccctacccttccttcaacaagtacatctctttttctcttactcactctcgctctctgtcgttagaatacctgttccctcgaaataccccatgccggaaacacagtgctttatttttaatgtttagaacaacaatatataaagccaacttcctccctctgtctgtccctcccccccactctctctctttgtctctttctctttctcaacggggtctcactctgttgcctgccactctgtctggagggcagggtgtgattataactcactgtagcttcagacctcttgggctcaagcgatcctcccacctcagcttcttgagtagctgggactataggcacttgccaccatacctggctaaattttttaaatttgttgtagagatgaggtttccctatgttgcccaggctggtctcaaactcctgggctcaagtgatcctcctgccttggcctcccaaagcgtgggggttacaggtgtgagccaccacgcccagcccccattctctttcttgataataatcaaggccacattttatgatctgagatatttcctcctgtccccacccctgttcccatccttacctgtcccaccatttagcatcttttgagctggaatctgaaggcagggcaggaaagataaatgataaaatctatactttcttcctttgaaagcaggaggcctgtctctgccctaaaattagatgtgtctgttctgtgtccccaggtcatacaggcatgcgtgatgggcatttagttctcctcagaggcagggaaatgcaatcggagaagcatggggtggggcagctgcttcactctgggcgcccctgtccaccaggccacgaggcaaccgcagagagaaagggcagtaagtttcaggaccctggagttgctcaggcagtgttaattctcttccccttccttgagtttagctctttttttgttctgtagcacaaacttagcagtccttacacagtggtgaagaagaatagaacagtccagaaaagggccatctctcctgagtctgtatttcctcttccacaggaagctaaaaacactctctgcctgatacagaacaagctcaaggaggaagagaagcgcctgctcaagagtggaagtaaggctgggcttcgtagacgagcagtttactctggactagtattttcagccttgaaatatatatagagagatatatatatattttttaatatgtattttcttctttttttcagcagttttttttttactgtagtaagaacacttcactttacatcttcaattttgaaaagtataataaattattgttgactataggtacaaaaatattttcaaaaggcggttttctcacaacttctatattgggtaccattgtattcactcaagagtctggtttaaatatagcatttaaaacacatttcgttcttgtgccagttaagatagtgttttcccctgtttaaatgatagtttgaattatatatgatgcgtaactataagaaaacatggccctagatgtgtgtagggttctgtattttcaggctgaatgatggaaagcaagcactgggatgcagtgcagggagaggggccgctcgctttgtgatggtccccatgctgctgagatgccccccataatccagaatggctcagcaagacactcagctggagagacacagggttacgtccatgcaaagcctagattccgggaaggagctctctgtgaccaggcagcttcccttatccttgtgtgggcggcaagccgcccaggtgccgaggcaagagaccgagagcacgagctgttccagtataataaaatatataaaataagaatagttatactagatatagatcatagatatgattatatatgaatatcattaatcattagtttatagcaattactctttattccaatatcataataatcctcgctctacaatcataacctaggaaaaaacaggccatacagatataggagctgaggggacatggtgagaagtgaccagaagacaagagtgcaaaccttctgttatgcccagacagggccaccagagggctccttggtctagtgggaacaccagcgtctgggaagccgcccgttgccaagtggaccgtggtctagtggtagcgtcagtgtcaaggaaaaacacctgctacttagcagaccaggaaagggagtctccctttccccgggggagtttagagaagactttactcctccacctcttgtggagggcctgacatcagtcaggcccgcccgcagttatccggaggcctaaccatctcccggtgatactgtgcttcagtggtcatgctcctagtctgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctgatccactttgagttaatttttgtatatggtgtgagacagggggtccaacttcattcttttgcatgtggctattcggttgtcctattatcatttgtggaaaagactattatttccccattgagttatactcgcatgttgtcagccattaattttaattgtcactgtcagctcagtggtttcagtgtcagcatgcattaatgtcttagtctgttttgtgctgctgtaacagaatacctgagactgggtaattatatattttacataaaatatatacagcattgtatatatggatacatgcagtcatccctcaatatctgcgaagaactggtgccagaacccacctgtggataccaaaatccacagatgttcaagtccttttcatgtaacctatgcacatcctcccatatactttaagtcatctctagattacataaaatacctaacataatgcctatacatcacttcattcacatggattcaacatagtacttggtatgtggcaaattcaagttttgctttttggaactttgtagatcttttttgaactttgtagattttttttccaaataattcagatccatggttggctgaacccatggatgtgaaatccatggatacagagggccagttttgtatgtgtgtgtgtgtgtgtgtagtttatatatatatgtcatatatattattatatataatatatattatattatatattattatatataatatatattatattatatattatataattatattatattatatatattatataattatatattattatatgttatatattattatatattatatattattatatattatatattatataatattatatattattatatattatatattatataatattatatattatatattattatatattatatattattatatattatatattattatatattatatattattatatattatatattatatattatataatattatatattatatatattattatatattatatattatataatatatattatattattatatattatataatatatattatattattatatatatattataatataatatattatataatatattatataatatatattttataatataatttataatttataaatttatatttataattatatatgttatatagttatatattattatatataataatatatgacaattatataacatatataatatattagtattaggttatattattatcattataatcagaaacttacttgtctgaaatttaatgagccacagttctaggagcaagcccaagatcaaggagctgcatcttgccgcaccatcccatggcagaagggcaaagagagggcgagagagagcaagagatcaaactcacagcctcaagcccttttataaccagcattaatccattcttcaaggcggagccctcatgacctaaacacctcccagtatgccccacctcccaacactgttgcattgggatttaagtttccaacacaggcttttcggagacacattgaaatcatataatagcaattgactttagtttacctgctcacttctcaggtctgtattggtttgagttgtaagaagaaatcttattgagcctgaggtacatgtattaattttattttaaaattgattatataatttgatttgcattgcatgggataaggatttaatgtcttaatttcctggatagaataagaaatgaacaaatgacttttgcacacagaccttactgggcagagctgtttcgttgtgatcatgaagccactcctttgttttgcctgcttgtgttcctgctaggtaacgatgactcggacatagacatccaggaggacgatgaatccgacagtgagttggaagaaaggcggctgcccaagccacagacagccatggagatgctcatgcaaggtaccccggcgtctttcgctggacttcctccctgcgccctgtttcacagaacacctggccaggactggggcaggctgcttagtattgaggcccacaagcgtgctgcgaatggcccctagaagcagctcttgctcaggtttatcctgtcctgttgtttatggctcttgaactgctcagtggtcatgtttgctccttgtctgtgatcccaagactggatggttcatatttatggcttggtatttctcacagccacaagaacacattgcctctgccactctcagtgcagtgatatacttaatagcctgagaattaatgcagaaagggacttaaatgagcatctctgccttaaaaaaagttcttctaattcctttactcatcacaaaagattcaagcaacaaagctcagcgcagtggtgcacaccttattcccagctactcaggaggctgaggcagaaggatcatttgagcctaggagctcggagctgtagtatgtgatgattgtgtccgtgaatatccactgcattccggcccgggcaacatagaggggctcttaaaactaagttaagccaggcgcggtggctcacgcctgtaatcccagcactttgggaggccaaggcgggtggatcacgaggtcaagagatcgagaccatcctggctaacacggtgaaaccccgtctctactaaaaataaaaaaaaaattagttgggcgcaatggcgggcgcccatagtcccagctactcgggaggctgagacaggagaatggtgtgaacccaggaggcggagcttgcagtgagccgagatcacgccactgcactccagcctgggcgacagagtgagactccgtctcaaaaaaaaaaaaagagttaaaacaaaaaaagactcaggcaacaaaatttgtagagcaaatgtgaattctctcctggggtcttcctcatgtcccactcccacctgggagggctcatggctagtggccagggtgggtgtgtctttacagattacctttctgtacatatacatacgcacacacatacacatacaaagatcacctgaaaaaaatttaacctgagtgcaaccagacggtatgtatggttctgcaacttgcttttgtttttaaaaattaagtacaattggaactcttcctctgtcagcaatagatctgccccctaattttttttttttttctttttgagacaaagtctcgctcttggtccccaggttggagtgcaatggcatgatcttggctcactgcaacctctgcttcccggagggagcaattctcctgcaatcccaagtagctggggttacaggcccgtgccaccacacccagctaatttttgtatttttagtagagacggggtttcaccatgttggccaggctggtctcgaactcccaacctcaggtgatccacccgcctcggcctcccaaagtgctgggattacaggcctgagccaccactcctggcctgccccctactttttaatggctatgtcatattcctagcaggactgtacccatgatttactgggcgttctcgcattgatatttcccctcttttccttgtatatacatctttctgcatgtctgcatatctttaggttgcatcattaaaagtcaaattcttaggtcaaaggttccataaatttttattttaatactataaaattctcctatatttgcctttaaaaacatttcttatctaccacctgttaatgtttggagcacagttgcttttttttttttttttttttttttttttggagacagaatctcattctgtcgttcacgctagagtgcagtggcacgatctcagctcactgcaacctctgcttcctggtttcaagcgagtctcctgcctcagcctcccgagtagctgagactacaggtgtgaaccaccatacctggctaatgtttaaaaaaatttctgtagaaatgaggtttcattatgttgcccaggctggcctcaaactcctggcctcctgtctcagcctcccaaattcctgggattatacgcaaaagccaacatgcctggccagaaaacaaatcttgaatgctatttcctgctttattttccaagatttttatgacttcttcatgcttttgttgttctcaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaa

SEQ ID NO: 955 - DNA, 27776 bp, Homo sapiens
cttggctcgctgcgcctctgcctcccaggttcaagagattcttctgcctcagcctcctaagtagctgggattacaggtacacaccaccatgcccagctaattttttttttttttttttgagatggagtttcactcttgttgcccaggctggagtgcaatggcacaatctcagctcactgcaacctctgcctcccaggttcaagtgattcttctgcctcagcctcctgagtagctgagattacaggcatgcgccaccacacccagctaattttttacttgtagtagagtcagggtttctccatgttggtcaggctagtctcgaactcctgacctcaggtgatctgcccgcctcagcctcccaaagtgctaggattacaggcgtgagccaccgcacccggctttgtatttttttttttttttttagcagagatggggtttcaccatgttggccagctagtctcaaactcctgacctcaggtgatctgcctgcctcggcctcccgtagtgctgggattataggcgtgagccaccgcgcctgtcctcacatgtgggtttttaaccaggagcgacactcgtcagcaagagaagtgtctagagattggggcatattttgatggtagatctcacgggatgaggcatgggttgagagtaagtcaggtgctacaggccgggtcttggggcagccgtgcggcagagcttgcagagctcatgggtgtgttccgcctctgtgctgtactctacgggaaccactggccacatgtggcaagcacaactgaggaactgagttgagttctgcattttctttaattcttaagtaatttaagtgaaaatggccacatgtggctattggttactatattagacatcactgctctgaagttttttgtgtgagcccctggaaggatgaagttgccatgtactgaagcagagaaggttctgcacatgctccatttgccacgccgattggctgtccaggtggagatggtgcacaggtagctggtatgtgaaactagagcccagggaaagcccaggctggagctgggagctggggagcaatcagcacacagatggtattaaagccttgagggtaggagcagagccagcagaaaagacggggggtccaggaatgaaactctgactcgctccacttttgagaagcagagaaggtgacagactcctgcaaagaagtttggggatgtgctgctcggaagggaagaaaagcagctagagccagagcaggctggatcctggaggactaaggaagagggaagcaagctatcaaagccatcagctgcaaatgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttctgcctataatcccaacactttgggaggctgaggtcggagggtcacttgaggccaggagttagagagcagcctgggtaacatagccaagaccctgtctctattaaaaaacatctgttgctgaggtttctgtttttgttattttccttccagattgcagatttgaaggcagccaggcagcttgcgtctgaaatcacctccaaaggagcatctctgtatgacttgctcggcatggaagtagagttgagggtaagcattccagtacttccttaaccatgcagattttctcttcaaggttttctttttcaattctgtttctcccttttcagttctgatttaatgaaatacacctggttgaatgagctaatgtgtggaaaggtgatagaggatattagctgtccttcctgcttctggtgggcactggtctagctttatttatttatttatttatttttatttatttatttttgagacggagtctcgctgtgttgcccaggctggagtgcagtggcgcaatctcgtctcactgcaagctccgcctcccaggttcacgccattctcctgcctcagcctcccaagtagctgggactacaggtgcctgccaccacacccggctaattttttgtatttttagtagagacagggtttcaccgtgttagccaggatggtctcaatctcctgacctcgtgatctgcctgccttggcctcccaaagtgctgggattaccggtgtgagccaccgcgcccggcactggtctacctttaacttcttgtttaggagtggcagctccatggcatgtgactgagctgtccttgttgtgcccactggcagactttattgatcatgatgtttttttctggtgtactctgcttcagcattttctcaaaaatgatcttctgagcttgcagttccccgaccttgctgcccagtgcaaacacctggggacctctaaagacttctgaagcctggctttcactctggggtccttgttatggaatgtgacctgggcattgggagttttcagattctcccgggtgattctaacagcagtttgggaccagcaatcttggcatcacttccagtcagctgaagttgatgttgcagtggagactgatttgatttgcaatccttattccagccaatgccagccaagaagtatgtgccatcacctacatttaagtagctgtttaagactggagtggtgtttattttttatttttttaattttgttattttttttgagacagtctcactctgttgcccaggctggagtgcggtggctcaatctcggctcactaaaacctccgcctcccaggttcaggtgattctccttcctcagcctcctgagtagctgcaattacagatatgtgtcaccacacccggctaatttttgtatttttagtagagatggggtttcatcatgttggccaggttggtctcaaactcctgatctcaagtgattcgccttcctcggcctcccaaagtgctgggattacaggcatgagccactgcgtctggcctagagtggagtagtgtttaatccttacctgtaaagatttatggcatttgaagcatatgtgctcaatctaatgctttaaaactaaatgaatttctttcattcacttcctagcaagagtgccagccatggcttctctctctcactgccttgcctgtgttctggcataccctgggagcaaactggaagtggaagtctggggaagagggacttaggtgctagattgctatgtctgctcatcatatattgacccggcagttgccacctgatgaagtgtggttggcagaatgaaactgccactgacatctgctagctaattcagatgatgagtaaggtacctccaggctttcccctgttctgtttgtagtgcagtggtgtacatatgtctgtacatgtccctaagagactcagagacaggagctggccacttgctgattgccactagagctgtggcatcattgtgagacttcatttccatcccacggggtctctttcaacaccatcctgtaaagaatgatgaagtaaccagtggctgaaactgttcccaaggaaaccatgagaccctgaatgtagtacttgtcaaattctgtgtgtagtcatgatccgaggaagagcgcctatccagtgtttgtttttctttcattcagtaaacatttactgaggtgcagcctcagccacaggcaaggcactgagctctgcctccttgactaagtcctcaccctgccctcagccattcccaccaggtgcaccgtggatgaaaggaagcacaagacgagttttgacacagtgcttcaggaaccttgtcttactttgttcaggctgccgtcccaaaacacaataagctgagtgacttataaataacagatttgtttctcacagttctggagattgggaagttctagatgaaagcactagcagcttcagtgtctggcgagggcttgttccccacagatggtgccttgttgctgagtcctcacatggcagcaggggtgagggatctccccagggtttctcttaggagctaatcacctcctaacatcatcacattgtggtttcgagtttcaacataggaattttggggtcacacaaacattgtctatagtaaacctcataactatatccacattacaatcccatgtctcagaagttttcagcactgatatgatagtcacagatgtctcccttgataggttaatggttcatgctaggggcagggccatggtcactgttcttatcggttgcgtttgttagtgataggcaactgagagggacttcatgctaagaaagatgcttagtttgggagtcacctggacagaatgcaggtaaagaagcaaattggggctgggcatagtgactcatgcctgtgatcctagcactgtgggagaccaaggaacgtggatcacttgagcctaggagtttgagcaacatagtgagaccctatctctatttaaaaaaaaaaaaaagaagcagcagcaaatttgggagaaaagataatggatgctaagttcagttttgctcatagagttggggtcacctaggcctctggctgaaaaggaggaccttgagctctggagagagctgggtaggcactcagataatggaagacattataggaggtgatggtggcagtgtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttggtaagatgactttgcttttatataatgttttttatgcctgggattcaaaaatactgatttcttgcccatacaagacagaacaagctaggcttagtaacaagggatgtgttagtggggaaatgaaaaactcaagaggacattcgagcttacctaggtcacttactatcatttttttcccctcgttataaataaaaacagcttctcatgttattaaaaattgatcagtttcagtaatttgataattatcagttattcaataattttaataaataatgctctattttattttgtttaaccaattcctcactgcttagtatttaaatgatttcagggttttctaaattccagacagcactgtaataagtagaaggatcactattgtttactgctcgctcacatcagttatcctctcatctaaagcagtcagttggaaggcagatcatgagggtgactctagactcagattgcttgggtttgaattccactgtgtgatattaggcaagttacttaccctctctgtgcctcattttcctcatctgtaaaatggcaagaactgcattcccaactgtgtggggtccttataaacatgaatcacgacagggcatatcaagcctcgtctctgatgcacaattgataatcagtcatcactggtgatttattttactcagtagacacggatgagggcccctgtgtacattcagagtaggcataaaacaagaatttgctatgagttgtacaaaattctaaaaatcataggtttttaaaaatatgtaattcttttgtcattaaacagtaatacctgctgggcagcccagcctagggagtcagagcctcacagcgggagaagggcaccacagccctggtgggagattggtgacagataggcagatgggtcagataagtaaaaatatggcaaggataatggagccacgttcctcactgttggagaaaaaagtcacaaaaatgtcacaaaaatggaaagagagaaaattagggtgaacttgaaattggaggtgttggttaaacgcatagttttcaatatatagataggtataggaataaattttgatatacatgtatgcacatttaaggaattacgtatatatgtatataaatgttttatttatatacatacacgtagagacacccacactcatacatttcttagctctgagcacacgtagcacctggcttaatgccattctccactaaaaggaaccaggactcttaggggaaaatggctaattccagagttgggcaggagaagtacgagaaagtaaggaagagttcaaaggaggaaagggaactattggaagcatgcagaagccaacttaagtgggcttctcctggccaaagtaaggacaacttaagcatcaaaataaataagttagaataattaattttatggtataatagaatgaaataggaaaccatgagttttcactggcataaaaaaataaatgaatattggaggctgaggaggagcaggtcattcacacagattcgaagtaactttccacaaagtactttttttttcttttttttttttttgagacggagtcttgctctgttgcccaggctggagtacagtggcacaacctcggctcattgcaacctctgcctcccaggttcaagtgattctcctgagtagctgggattactggcgcacaccactacacccagctaattattgtatttttgttttattttatttatttatttgtttatttttttagacgaagtcttgctatgtcacccaggctgaagtgcagtagcgccatctcagctcactgcaatctctgcctcctgggttcgagcaattctcgtgcctcaacctcccaaatagctggaagtacaggcatgcgccaccacgcccagctaatttttgtttttttttttagtagagatggagttttgccatgtttggccaggcttgtctcaaactcctgacttcaggtgatccgcccgccttgacctctcaaagtgctgggattacaggcatgaggcattgtgcctggcccgcagagtacttattaattacagaggggaaaagagtcacttctcagggagaagcctgccagtcacccccttaatcaagagatcaaagtgaacatcatcgttacagaacaaatcaaaatcatgcacgcctggtaggatgcagtcacttctgagtattcctgccaacgatgcatatctgactctaatgagacaaagccggattgaggggcattctacagattaaccagcctgtatgctcccagagtgaaaaggttctgaaagtcaaggaaagctgagggggcatttcagactgagggaggctgtggagatgtgataactggacacataggcagctcctatctgctgttggggacttcactgggacaagtggggacagtggagtggggctggagttagacggtggtagtgtgttagtgctggcttcctgttttgatgattgtattgtggggatgtaggagaaagtccttatttgtaggaaatacacgctaaagtattcagggtattggaacgtctggtcagcaacttactgtcacctaggttgggaaaaacgctttgtgttgtacaacaggttttccgtaaatttttgattgtttctaaatttaaaaattaaaaaaaaattattatacctcttatccttgccagtgttctaactgaatcaggtgaacacggcatgaatgtgcccttagcactaatatgttaaaagtagaacacccaagagaggacagggttcatttcttggtagacatctcttaagactcctttcattgttagaaaatatctgtgatgtttgatcattctaaaaacaaccaaaacaacatgggtacttaaaagggtttggggagtacaggccatttatttcagaaaccagggaaaattgcttgtgtttacacagctgttttgcattgtggatctttcttgtttgaggaacagatatgtttaaggtgggataaatttactaggttttaatctgactttggttcgaggaaacagttgccattaactgaagttgtttagaaaggagacccacctttcttcctgtgagggtgaactcgcatttctcctgggggctctaaggcacttgcagcaaatcgatgataagggtctgattattttcatgaaagtatcttagaagtggctagtgtacttagaccaaaaaaattagaccataaacgcattgtcagtaacagtggctggttccaaaacacaccatgcctgagagttgtggagagtgtctgggcttcgtaggccatttctctgtggagcccatagcttttcagagacttgcaggaaaacagagtaaccccttcgtgggatgctacacataggcaaagagctggaggggaagccccaccttggccaccaggaacttaatgcagggctggaaagccagaaccctggggggcagttccacgctcagctgggtggcagtccagattcctcataaagagattggagcctgaaccccaggcatgtgatccagccagccaccggacaagacgcatgtgaagacggcgcactaccagtgactctacctgcttcaaatgaaccttctcttaggatagggagacttgtgtcaccgtcagtgggcccgtgtcccccttcccttctttactcagcctctgttgcccaagggcctctgtccaactgttgccctggaccccttccagagctggtgcacaccagtgtggccattgccactgtgggaactgctttcgtactgtcttcagagtggtttctcctcgtttttagtctgtagtcaagcttctgttgccagggagagggaagaggaccttctctcaatcccagcaggcagtgggttagggctgggaccagctgtttctttctctcccctcctagtagagcagtacttggtgtgtgtgggtattctgtaagtcgggtgtttgtaactaggggcatggcccgaatgataaaaaggcagactgaccgtccagagtgatgtgcaccttgttctaaccgagtgagccagagaaaagactgcaggcctctccaccttgaccaggacactcttctttgcatcttcacttctttccctgggtagaaatgcctgcttttcatggggaaaaaaaaagagatacctttttctggacctgtgtgacattctccctggaactagtgggttaagtgagtcattgcttggggaagtgtctatttgtttgcttttgtgtttgttgagcataatgttgctatgcctgaagagttgcaaaattcttctaagaattaggatggctgtttttattgccaccttgtctcattatttcccattaaatatagacacaggttcagaagactaaagacctgctcaataatgtggcctctgatgaagctaatttagaagccaaaatcgaaaagagaaaattagaactggaaagaaatcggaagcgactagagactctgcagagtgtcaggtagatatgaacacttggagaatgagtagaaagatgtcctggaaagttcaaacaaactgggcgtggtggctcatgtctgaaatctcagctactcatgaagctggggcggggggttctcttgagcccaggagtttgagaccagcctgggcagcataatgaaaccccatctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaaaaagaaaaagttcagcaaaccagtatagatttttatggttttttttgtttttgttttttttttttgagttggagtttcgctcttgttgccgaggctggagtgcaatggcgcgatcccggctcactgcaaactctgcctcccggattcaagcgattctcctgcctcagcctctcaagtagctgggattacaggcggccgccaccacgcccagctaatttttgtatttttagtagagacggagtttcaccatgttggccaggctggtcttgaactcctgaccttgtgatccacctgccttggcctcccaaagtgctgggattacaggcatgagtcatcatcacgcctggcctttttaaaaaattttttatcgtttaaaaacctctttagactgggcacagtgattcacgtctataatcccagcactttgagaggccaaggcgggcagatcgcttgaactcaggggttcaagaccagcctgggcaatatggcgaaaccccatctctacaaaaaaaaaatataaaaaatagctgggcatagtggcacatgtctgtagtcccagctacttgggggcctgagacaggaggatcacctgagcccaggcgttcgatgctgcagtaagccatgatcacaccactgcactgtagcctgggtgacaaagtgagaccctgtctcaacaaacaaaaaaaaaccaccagccttaattcgtaacaacctgtggtcccctttttagaggattgctttaaatttataatatcctgacagtagaacattattattattattattatttcttttgagatggagtctctctgtgttgcctaggctggagtgcagtggcgcaatctcggctcactgcaacctccacctcccaggttcaagcagttctcctgcctcagccacccgagtagctgggattacaggcatgtgccaccacgcctggctaatgtttgtatttttagtagagacgaggtttcaccatgttggccaggctggtctgaaactcctgacctcagttgatccacccgcctcagtctcccaaagtgctgggattacaggcgtgcgccaccgcacccggccaacagtagaacattatacccaaataagataataatatatatatttattgatttggagagatgtgtctggtatgtgatttttttgcctttagagatggggtctcaatgtgtcacccaggctggagggctggagtgccacggcaaggtcagaggatcctcactcactgcagccttgaactccagggctcaatcctcctcctacttcagcctcccaaagtgctagggttacaggtgtgagccgatgcacccagcctgatcatttttaactctattgagattacggtatattgaaatgaaataaagattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctgttcagccattccttctggtgtgttattttgtactgggtgacaggtcattttgttaatatcattgtgaaaaaaatatcagtacatgttttttctccctggtcagtctgaggattgctcatgtaatgtgtttgttttgctggcagtgtacactggactccagggttgtcaaatctttgatgtcatatttcatcaggtttggtcagttaagagaacagacagggccgacatgaggcctgtgtggctgcgtaagaccctgtgccgacatggggcctgtgcttgctttcaggccctgttgtcactgtcttgaaattcataataatttttaagtgcattttattttccactgatcccaaaaattatgtagctggtctcgagtgcagatttaaaagcttgcttggctttgggaggccaagacgagcggatcacttgaggtcaggagtttgagaccagcctggccaacatggtgaaacccctcctctcataaaaatacaaaaaattagccgggtgtggtcgtacacacctgtagtcccagctactcggcaggctgagacaggagaatcgtttgaacatgggaggaagaggttgcagtgagccaagatcgtgccactgtactccagcctggacaacagagcaagatcccatctccaaaaataagaaaataaagcttgcttagtcagttcacataaagattttcaaggcaaggtgcgatggcttatacttgtaatcccagcactttgggaggcttaggcaggaggatcactggagcccaggagtctgagaccagtttgggcagcataatgagaccctgtctctacaaagaagtaaaaataaattagctggacatggtgttacacacctgttgtctcagctacttgggaggctgagatggaaggattgcttgagcctgggagtttgaagttggagtgagccatgatcatgccactgcactccagctcggttgacagagcaagaccctgtctcaaaaagaaaaaaaaaaagggccgggcgcggtggctcacgcctgtaatcccagcactttgggaggccacagctggtggaccacgaggtcaggagtttgaaatcagcttgtccaacatggtgaaaccccgtctactaaaaatacaaaatttatctggtatggtggcgggcacctgtaatcccagctacttgggaggctaaggcaggagaattgcttgaacccaggaggcagaggttgcagtgagccgagattgcgccactgcactctagcctgggcgacagagcaagacaccatctcaaaaaaaaaaaaaaaaaaaaaaaaagaaagagattttcaagtcctggttaattgaatcaccagaatagctcattggagattgttttgtaaagaggaatggcagtttatttattgattgtgggaaataaatgtgtggccttgagcctgaccaaccatcttacaggttcctctcatccctgtgggtaaggccatttaggaaaagagtgttttagacccgagcatgagttgataaatgtggaatttagagcaaaggaaattgaaccaagttgtgatcagtttttgaattgccctatccttaacctgagaatggtcatttagactccattttcatgatgaaattggtctgcagtctccctttctcatgcccttgacagcttttggtattaaggttatgctaggcttcttacaatactgagcatttgagtttggcagagctattttgttgtccaggagggctaactgggagtacctaacgcatccgtgtggacacatgtcatcttgacgaggaattcattgctagcattactctgtggcagaggcaggccatggagaaatggtacgggacaggcacatttcgagggcactagaaagagcttggagtttagaacattttaaacattgggtacctgggaaagaacagtcaagggcagtgaaaagaaacgttggccatttttttgtattatctggggccacctctgggttcagagaacaaaccaaacagtatgcctcagagtggcaggtaggtggcccaggaaacttcccagggagcccctctaccctacccttccttcaacaagtacatctctttttctcttactcactctcgctctctgtcgttagaatacctgttccctcgaaataccccatgccggaaacacagtgctttatttttaatgtttagaacaacaatatataaagccaacttcctccctctgtctgtccctcccccccactctctctctttgtctctttctctttctcaacggggtctcactctgttgcctgccactctgtctggagggcagggtgtgattataactcactgtagcttcagacctcttgggctcaagcgatcctcccacctcagcttcttgagtagctgggactataggcacttgccaccatacctggctaaattttttaaatttgttgtagagatgaggtttccctatgttgcccaggctggtctcaaactcctgggctcaagtgatcctcctgccttggcctcccaaagcgtgggggttacaggtgtgagccaccacgcccagcccccattctctttcttgataataatcaaggccacattttatgatctgagatatttcctcctgtccccacccctgttcccatccttacctgtcccaccatttagcatcttttgagctggaatctgaaggcagggcaggaaagataaatgataaaatctatactttcttcctttgaaagcaggaggcctgtctctgccctaaaattagatgtgtctgttctgtgtccccaggtcatacaggcatgcgtgatgggcatttagttctcctcagaggcagggaaatgcaatcggagaagcatggggtggggcagctgcttcactctgggcgcccctgtccaccaggccacgaggcaaccgcagagagaaagggcagtaagtttcaggaccctggagttgctcaggcagtgttaattctcttccccttccttgagtttagctctttttttgttctgtagcacaaacttagcagtccttacacagtggtgaagaagaatagaacagtccagaaaagggccatctctcctgagtctgtatttcctcttccacaggaagctaaaaacactctctgcctgatacagaacaagctcaaggaggaagagaagcgcctgctcaagagtggaagtaaggctgggcttcgtagacgagcagtttactctggactagtattttcagccttgaaatatatatagagagatatatatatattttttaatatgtattttcttctttttttcagcagttttttttttactgtagtaagaacacttcactttacatcttcaattttgaaaagtataataaattattgttgactataggtacaaaaatattttcaaaaggcggttttctcacaacttctatattgggtaccattgtattcactcaagagtctggtttaaatatagcatttaaaacacatttcgttcttgtgccagttaagatagtgttttcccctgtttaaatgatagtttgaattatatatgatgcgtaactataagaaaacatggccctagatgtgtgtagggttctgtattttcaggctgaatgatggaaagcaagcactgggatgcagtgcagggagaggggccgctcgctttgtgatggtccccatgctgctgagatgccccccataatccagaatggctcagcaagacactcagctggagagacacagggttacgtccatgcaaagcctagattccgggaaggagctctctgtgaccaggcagcttcccttatccttgtgtgggcggcaagccgcccaggtgccgaggcaagagaccgagagcacgagctgttccagtataataaaatatataaaataagaatagttatactagatatagatcatagatatgattatatatgaatatcattaatcattagtttatagcaattactctttattccaatatcataataatcctcgctctacaatcataacctaggaaaaaacaggccatacagatataggagctgaggggacatggtgagaagtgaccagaagacaagagtgcaaaccttctgttatgcccagacagggccaccagagggctccttggtctagtgggaacaccagcgtctgggaagccgcccgttgccaagtggaccgtggtctagtggtagcgtcagtgtcaaggaaaaacacctgctacttagcagaccaggaaagggagtctccctttccccgggggagtttagagaagactttactcctccacctcttgtggagggcctgacatcagtcaggcccgcccgcagttatccggaggcctaaccatctcccggtgatactgtgcttcagtggtcatgctcctagtctgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctgatccactttgagttaatttttgtatatggtgtgagacagggggtccaacttcattcttttgcatgtggctattcggttgtcctattatcatttgtggaaaagactattatttccccattgagttatactcgcatgttgtcagccattaattttaattgtcactgtcagctcagtggtttcagtgtcagcatgcattaatgtcttagtctgttttgtgctgctgtaacagaatacctgagactgggtaattatatattttacataaaatatatacagcattgtatatatggatacatgcagtcatccctcaatatctgcgaagaactggtgccagaacccacctgtggataccaaaatccacagatgttcaagtccttttcatgtaacctatgcacatcctcccatatactttaagtcatctctagattacataaaatacctaacataatgcctatacatcacttcattcacatggattcaacatagtacttggtatgtggcaaattcaagttttgctttttggaactttgtagatcttttttgaactttgtagattttttttccaaataattcagatccatggttggctgaacccatggatgtgaaatccatggatacagagggccagttttgtatgtgtgtgtgtgtgtgtgtagtttatatatatatgtcatatatattattatatataatatatattatattatatattattatatataatatatattatattatatattatataattatattatattatatatattatataattatatattattatatgttatatattattatatattatatattattatatattatatattatataatattatatattattatatattatatattatataatattatatattatatattattatatattatatattattatatattatatattattatatattatatattattatatattatatattatatattatataatattatatattatatatattattatatattatatattatataatatatattatattattatatattatataatatatattatattattatatatatattataatataatatattatataatatattatataatatatattttataatataatttataatttataaatttatatttataattatatatgttatatagttatatattattatatataataatatatgacaattatataacatatataatatattagtattaggttatattattatcattataatcagaaacttacttgtctgaaatttaatgagccacagttctaggagcaagcccaagatcaaggagctgcatcttgccgcaccatcccatggcagaagggcaaagagagggcgagagagagcaagagatcaaactcacagcctcaagcccttttataaccagcattaatccattcttcaaggcggagccctcatgacctaaacacctcccagtatgccccacctcccaacactgttgcattgggatttaagtttccaacacaggcttttcggagacacattgaaatcatataatagcaattgactttagtttacctgctcacttctcaggtctgtattggtttgagttgtaagaagaaatcttattgagcctgaggtacatgtattaattttattttaaaattgattatataatttgatttgcattgcatgggataaggatttaatgtcttaatttcctggatagaataagaaatgaacaaatgacttttgcacacagaccttactgggcagagctgtttcgttgtgatcatgaagccactcctttgttttgcctgcttgtgttcctgctaggtaacgatgactcggacatagacatccaggaggacgatgaatccgacagtgagttggaagaaaggcggctgcccaagccacagacagccatggagatgctcatgcaaggtaccccggcgtctttcgctggacttcctccctgcgccctgtttcacagaacacctggccaggactggggcaggctgcttagtattgaggcccacaagcgtgctgcgaatggcccctagaagcagctcttgctcaggtttatcctgtcctgttgtttatggctcttgaactgctcagtggtcatgtttgctccttgtctgtgatcccaagactggatggttcatatttatggcttggtatttctcacagccacaagaacacattgcctctgccactctcagtgcagtgatatacttaatagcctgagaattaatgcagaaagggacttaaatgagcatctctgccttaaaaaaagttcttctaattcctttactcatcacaaaagattcaagcaacaaagctcagcgcagtggtgcacaccttattcccagctactcaggaggctgaggcagaaggatcatttgagcctaggagctcggagctgtagtatgtgatgattgtgtccgtgaatatccactgcattccggcccgggcaacatagaggggctcttaaaactaagttaagccaggcgcggtggctcacgcctgtaatcccagcactttgggaggccaaggcgggtggatcacgaggtcaagagatcgagaccatcctggctaacacggtgaaaccccgtctctactaaaaataaaaaaaaaattagttgggcgcaatggcgggcgcccatagtcccagctactcgggaggctgagacaggagaatggtgtgaacccaggaggcggagcttgcagtgagccgagatcacgccactgcactccagcctgggcgacagagtgagactccgtctcaaaaaaaaaaaaagagttaaaacaaaaaaagactcaggcaacaaaatttgtagagcaaatgtgaattctctcctggggtcttcctcatgtcccactcccacctgggagggctcatggctagtggccagggtgggtgtgtctttacagattacctttctgtacatatacatacgcacacacatacacatacaaagatcacctgaaaaaaatttaacctgagtgcaaccagacggtatgtatggttctgcaacttgcttttgtttttaaaaattaagtacaattggaactcttcctctgtcagcaatagatctgccccctaattttttttttttttctttttgagacaaagtctcgctcttggtccccaggttggagtgcaatggcatgatcttggctcactgcaacctctgcttcccggagggagcaattctcctgcaatcccaagtagctggggttacaggcccgtgccaccacacccagctaatttttgtatttttagtagagacggggtttcaccatgttggccaggctggtctcgaactcccaacctcaggtgatccacccgcctcggcctcccaaagtgctgggattacaggcctgagccaccactcctggcctgccccctactttttaatggctatgtcatattcctagcaggactgtacccatgatttactgggcgttctcgcattgatatttcccctcttttccttgtatatacatctttctgcatgtctgcatatctttaggttgcatcattaaaagtcaaattcttaggtcaaaggttccataaatttttattttaatactataaaattctcctatatttgcctttaaaaacatttcttatctaccacctgttaatgtttggagcacagttgcttttttttttttttttttttttttttttggagacagaatctcattctgtcgttcacgctagagtgcagtggcacgatctcagctcactgcaacctctgcttcctggtttcaagcgagtctcctgcctcagcctcccgagtagctgagactacaggtgtgaaccaccatacctggctaatgtttaaaaaaatttctgtagaaatgaggtttcattatgttgcccaggctggcctcaaactcctggcctcctgtctcagcctcccaaattcctgggattatacgcaaaagccaacatgcctggccagaaaacaaatcttgaatgctatttcctgctttattttccaagatttttatgacttcttcatgcttttgttgttctcaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtcttt

SEQ ID NO: 956 - DNA, 1231 bp, Homo sapiens
gctttgtgaaatgggccctgcttctcttgtccttttgtactaggagaaatgttaaatagttagaaaccgacctggattactccgatctgaactgagatcacatgggactttaatagttgaaaaaacgaacccttaatagcggctacactattaggatgtcctgatccagcattgaagctgtaaaccctgttgttgatatggaccctagaataggattgtgccgttatccctaggataacttattccgttgatcaaattattgggtcagtgtgtgttaacttgcttagactagtgcggtcttagtttaggtagtttggaggttgaattatgctctgaaataaaagaaaatttttattttttttgttttttatttatttattttttaagacagagtctggctctgttgccaggctggagtgcagtggcacgatcttggctcactgctatctccacctcccgggttaaagccattctcctgcctcagtctcctgagtagctgggattacaggcacataccaccacacccagctaatttttgtatttttagtagagacgggatttcaccatattggccgggatggtctcgatctcctgacctcgtgatctgcctgtctcagcctcccaaagtgctgggattataggcgtgagccaccacgccgggcaccccaaccaaaatttttaatgcaaagatagtaggctagggcctgtaggctttttttgagtttctatttgcattaatgaattaaagctctatagagtcttctcatcttatttgtttatactgcctcttcatggataggtcaatttcactgactgaaagtaagagacagctgaacccttgtgtggccattcatacaagtccctatttagggaacaagtgattatgctacctttacaatgtcaggataccgcagctgttgaacatatgtcactgggcaggcggtgcctctaatactggtgaagccagaggtgatgtttttggtaaacaggtggggtaagatttcccgagttccttatactttttgtaatctttccttagagcatacctgtgttggattaatggtataaataatagggtatttattctttattaatattaggctgttaactatcagtggattctggtttgatataagcttatgcaatggagaatgtcttcgtgttactaatattaacattattgcttctattaagtaatagattagtctaatgtaatgttaggagttcaata

SEQ ID NO: 957 - DNA, 38357 bp, Homo sapiens
ttcaaatactcaatttttattggtagtagttatcaagaacaaagtcctcggacttctgatgggaaatctgaactgctgtttctcttttagcgtacaagaagaaatagatccctctcattagcactttaatatcagtgtcacgtgtctggaaggaaattgtattcatttaggtaagcaacacactacataaatatcatagctgttagacccaggggactctcaggtgccagaattggggactcctttaattggaagggagctaaagggtctacctcctacctagaagtcctttctatgtggatatgaattaaattctcttgtctgttttgctctgatggggtctgtgtgggctagctggctctggtgtgtgcctgacgacagactgaactccttaaccatttcagacagcttgaagatgtatgatcattatttgaaaagggagagagggaggactctttgttttctccaccagtttggctcctgaggtttcttcagcgttaggtttctgtagggcccagctttctccagtgtttggctactgcaactctgtgttctgccagtctcttaactcagacagaaacaatgcaaaccagcagacagagcatcaccttgaaagtactaaaacagctgtcaatctagaaatctctgccccgcaaaaactgtcataaatactgcaagacccatgttcagatttccccccttttacaaataatgttttgttttatttcccagctactacaagtgatccaaatgttctttatagcagactttttcctgcagtctaggatccagtcagagatcttgcattaaattatatctctgtaatctttaatttcacgctatctgcaatgttttgtgtttttcatgacattgatgtttttgatgaggtcaggccatttattctgcagaatatctgtcaatttggattttttctaattgttctttcatgattagaatcaggcaaacattttttgacaagaatacatcagagacgactccgtggtgcatcagactgggggcatgtgatgtctgtgtgtcccattattggcgatgttcaattctgtcacttctgttgaggctgcatttgccagatttcagattaaggtacctttttccctttgtaaattaggatatcacctttgtggggtgccgttttgagactgcaaggatatcatcttcccgagtaggccttcatccatggcctcagcatccatgatggttcctgtccggatgctcacttttgaagaaacatttcaaataatagtgattcctttccaattcaaaagtaatcattgctttatagtcttcataaatattttctgtggttatttagttgatgaaagctgttgatgtccatttggatttttttccctccaacacaaacagctgcaggaattggtgccacatagaggctcagcttgcctgtctccatggaagctgtggccacagcagtggctttggaagcctagtaaggaatgacatcactgccaggtgcagtggctcacacctgtaatcccagcactttgggaggctgaggtgggtggatcacttgaggtcaggagttaaagaccagcctgatcaacatggtgaaaccccatctctactaaaaatacaaaaattagctgggtgtggtggtgcgtgcctgtagacccaactacttgggaggccgaggcaggagaatcactggaacccatgaggtagagcctacagtgagctgagatcatgccactgcactccagcctgggtgacagattctgtctcaaaaataaataaagaatgacatcactgaatacactgaatgtgctattgataaccagtgtgccagactccagacaacatgtgccaggcatcacccatgtctttgattttgtaataaataaaaaatggggccaggtgtggtggctcatgcctgtaatcccagtactttgggaggcccaggctgatggatcacctgaggtcaggagttcgagaccagcctggccaacatgatgaaaccccgtctctactaaaactacaaaaattagccgggcatggtggcgggtgcctgtattcccagctactggggaggctgaggcaggagaatcacatgaacccgggaggcggaggttgcagggagctgagatcgtgccactgcactccagcctgggcgacaagagcgagactccatctcaaaaacaaacaaaaaaggcaaaatccttggagaactcttactgtctctgtttccagaatcctagaattaaaactttcatttatcttcacaattttcccatagctttttcatgtctgtaaggatgataccctgaaatcttcttcttgagaagataaagaagggtcccctctgttacccctaccaaacggatgctcctcacgggcttgaggtggcagctcatctcagagcatgggatgatttttaaccaggtgagtggaaaggggcagtaataaacatttttaaaggttggggacacatgaagtcctcagggtgtaaagctggaaccagcctcctgtactgctcagctttcaggcctttggcccctagtcccttgggggtggcccctcccttctctgtgccataacagagtacccgtcaccccctgcctggaccactcctgcagcagaagaggagctcacgacctcctccggcagcacctctccttcctccctgcagagcccggctctcgtgctgagcaagcagcgttcccagctcccagacaggccccccagaagtcggcctttctgttcaaaagcttccagctgagcatctgcccattctcctgatccgtccaccaggatcacatttcaacagtgcacgtgggagcatttgtcttgatggcctctgagatcatcctggccccggagtccccaatgtggtttccctggagactagaagagtagggttaaggcagggctcaaagcctgcaggttctctttagtagagcaggccatacaatagaaaatgcaggaccccatgcaaagcctttgtgcttctaggatcccctcgctacatggacaaggctcagggtacctccccttagaccaggtttccctataggcctgctgaagcgtctgggggtcagctggctctcagaactgggcaaaaggcagtgcgccacctggaagcagttctaagggtgagcaggaagggcaggtgcactcacttgatatgctggagcctgtggtttccagacagtgctgtggcaatgcatatcgccccgtccatccccagagaattctcttgaagactaagtggaaaagagatggagacacacggtgagccatcagggcagaaggaaaacacccggggaagcaacagtgcattgtctgggggcagtaacccaggcagatgtgtccacaggtgccatggcaactccaggtgggagttgaccctggagacaggtgtctacgagtggccagattgtcccacgcaagtgcgctggaggatgtaaggccataaatgcaagatgtgagtgacttctgactgaagctaagcacactcaacaaacccagctgcagtggaatgtggactataataagtctgattgtttatattcagaaggaaatagctacagaagaaatcaggagcattttattccatcagggaggacccagcagagaactctgctgctccaggatgcaggtaggtccctccagccacttacttgagtctccggagacttgagtttaccttcagagcatttgccagggctttggctccagccaccccaatggcatttcctcttaagctgttgggaaagacaggaagcctaaggcatgggtacaggctgagaggtgatactgacccctctgcgggtgggcttggggctgcttggtagaggaaacaaggacttcagcagtcacaggaggccagggctgtgccttcctcactccagggcaacagggcagagctggctctgggaagcagggcacacaggggcatggctggcctagccaggagggttgttggagccttcctcctcttccatttcaaacagaaaagcggggctgagacaggagaggcagccctccatctgggcaggtccccagtgctcccagcaagggcaggaattctgaggacatgcctgagcctcagagctgtaacctcaccccaggactttggatctgcccagagaacaagatcagcccccctgggacccataaaccaggcctctagacgtgttcagcctggcaaggccaacccggagaggagggcaaatgatagcgactcccagggaaaggcatgaagtggggctgggaaactggtatacttgcactgaaatgaagatcaccaggatgatttgtgagttgtctgtaaactttgtccccatatctattcattgagaattcattgatttctttgggctaaagaccatagatggagactggaatacttactcgagaatctccaaggttctgttcacagccaaggcttcccctagcacctgggcgcctgaagcaccaattgaggccacctggagactggggcggagagggtgccgtcagtgtgagccggctgggcccacctccctccgcatactccgttccctttcaccaccccttgactcaggatggaaagtggagaaacagcactgagaatggttggccagcgctgtgtctaggcactccatctcctacctacactgtctgttgcctaagacagagatctggatgctaaggagatgagaaatagaggctgtccctggaagggctcggggagaatgctccctgtacctcctcattactactctctaggtgtttgagcccccaactgctaatatcatatttcctatattaggaaaatcaaacacaccttccttgacttgtaaacaaaaataacgtccaggccaggtgtggtggctcacacctgtaatcccagcactttgggaggctgaggtgggcagatcacctgaagtcaggagtttgagaccagcctggccaatatggtgaaaccccgtctctactaaaaatacaaaaattaggctgggtgtggtggtgcacgcctgttatcccaactactgtatgggaggctgaggcttgagaatcacttgaacccaggaggtggaggttacagttagctgagattatgtcactgcactccagcctgggtggcagagcaagactcttgtctcgaggaaaaaaaaaaaaaaaaagacctctaacgtgaaaggatggcgaagggaccggtttcctgactgctgcgcacatctaggacttactagagagcagtgagggctgtgttgaccttcagtgcacgggccaccgcacacgctccgtcatccccgatggcgttctcctgtaaactagacacagagtatgacccctttgggtgcacggggcacagggagcattctagcaaggccctgccgcacttggacctgccaggtttaaccgactacacacaccatagacactcccagggtttcctggggataactgcccttcctccacaggccctgcagcccgccgcctcatactaagcacacagaggcgtctggggcctgcatgagtctgaaccgccagaggcaagcaggaaatgggacatatagagtgactgtcagcaggggcttgggacccaaaaggggatgcttttcacagccaaccagaaaatgaacttaaagccctcaatccctgagccattcttgtttgtcttgttttctcttgagacagggtctcactctgccacccaggctggaatgcagtggtgagatcacggctcactgcagcctcaacctcccaggctcaagcgatcctcccacctcagcctcccgaggagactaaagtacttaactagagacggggactacaggcacatgcccccatgcccggctaatgtttttattcttttatagagatggggtctcactatgttgctcaggctggtcctgaactcctgggctcaagcagtcctcccaccttggcatcccaaattgctggcattacaggcaggagccaccacgcccaacctccttggccattcttgctaattagggctttgtgtcattttttccccttctaagttggagggaactagcaggccctggtgcagtgagtgactgagtttagctcaagcgcacactggtatgttcaaggccaagagctgtttgcattcattattttaacagacatttgagtgtggccgggcgcagtggctcacacctttaatcccagcactttgggaggctgaggtgggtggatcacttgaggtcaggagttcgagaccagcctggccaacatggtgaaaccccgtctccactaaaaatacgaaaattaggctgggtgggtgtatttttagtagagacagggttctctgtctctactaaattagctgggagtggtggagggcacctgtagtcccagctactggggaggctgatgcaggagaatcacttgaacccaggaggtggaggttgcagtaagccgagatcccgccactgcactccagcctgggcgacagagttagactccgtctcaaaaaattaaaatgaaaaaaaaaataagaaagacaacatttgagtgtgtctcatgtgctaggtgttgtataaggcagcaggcctgagtccccctctcgaagctcaggtgggaagacatgattaaatgagcaggtacaacaggccaagtgcaggctgcagggaaaagcaagcagcatctcccaccccagggtgtcaacagaaggctcccagaagaaataggtcaaaacccgaacccaaagtggggagtgtgcctggctcagctaaggaacccaaacgaattgaattcctggggaagtgagaaatgagtccagggagggacaaaggaagcagattttaggggtcccagaagccaccctgaggggctgtgtgtactttactctgcaggccctgggcaaccattcaaggatggcacccaagatgggacagagctgctctggaaaggtctctggccagcagtgtgagaggatggactgaggtggaggctaccacagggatggaggtgagtggtgccgatggcctgggcaggggcagtggacgcagagggaatcgagtggatggcagggacacagaggggaccgacccaacaggacttgacaatgaataggaagcaggaggtgggtaggcacagtgcctcacacctgtaatcctaggactttgggaggccaaggtgggaggatcgcttgagcccaggagttcaagactagcctgggcaacatggtgaggccccatctctttaaaaaaaattgtaaatattactttaaaaaataagttatatgctggatgtggtggtttgcacctgtaatcccagcactttgggaggccaaggtggaaggatcacttaaaggtcaggagttcgagaccagcctgaccaacatagtgaaaccccgtctctattaaaaaaaaaaaaaaaagctgggcgtggtgttgggcacctgtaatcccagctactcgggaggctaaggcaggagaatcgcttggacctgggaggcagaggttgcagtgagccgagatcacgcctctgcactccagcctgggcaacagagcgagactccatctcaaaaataaaataaaagttatagaaaaggaagtgggaggtgagagtgaaggtcttgtttctagcttgcacagttggttccattcacaagatggggagccaagaagcaggttttcaggagagagaatgcagggaccctgcacccgagcaagatcccgaagggaggtacagagggggtgtggacgcgcaggtctagggttgaggagagagggctgggacacggacgtgggagtcgttgggactttgaagatcactggagcccagggaaaggaaaagagctccaggaaaagagacgccaggcaagcgaagatgacataggacgatccctgaggagccctgcgcagaagagccaaacagaagaaaagaggacgaggcccagacagaggggacatcctggaagctgaaggagaagaaatggtcagggagaaaggccgatgaggctccaagggttaaacctagagttccctcacgccccagcgactccactcccaggtatatccagccaggagaaggaaagctcacgtccacacagaaactggtgcacaaaggtccacagcagcaccgttcctaacagccaagtaggaacaacccaacgtccgtcagctgatgaatggagaaatgaaacctgtgtacccatacaatggatatcattcagccttacaaaggaactaagtattgagacaggctacaatgtggatgaaccttgaaaatctgacaccaaatgaaagacaccagccacaaaaggccacgtgtcgtatgattctatttttggccacgtatcgcacaattccatttatatgcggtgtccagggtaggaagatcatggagatggtagattagtggttgccagggttgggggaaagggagaatgggtagtgagtgctaacggggtgatggaaatgttgtaaaattgattgtgatgattgcatcaccgaatacactagaaaccagtgaattgtatactaagtgggtggatcttctggcgtgaagattatatctcaatcaagctgtcatatatctatgtatatatgtgtatgtacatatatgtatgtgtatatatgtatatgtgtatatatgtgtgtgtatatgtgtgtgtgtgtatgtatatatatgtgtgtatatatatatattttttaacagggtctcactctgtcgcccaggctggagtgcagtgacgcgatctctgctcactgcaacctgtgcctcctgagtttaagcgattctcctgcctcagcctcccgagtagctgggattacaggcatgtgccaccatgcccggctaatttttgtatttatagtagagatgggatttcgccatgttggccaggctcatcttgaactcctgacacctcagatgatccacatgcctcagcctcccaaagtgctgggattacaggcgtgagccaacgcacccggccaatatatttaaaaggcagacaaggactgaaacatgccagctggccttagggaagaggagtgccaggggtcactggattgagcctctgcctgatgggtaccaggttttcagattcccctgtcctcaacagcccccgccctgcagcccctgggcaggccaacttactctaagctggtgaggctcctgttgagctgtagtgcttgtcccagggcctgggcagcgccggcctggatgaagttccactgcaggctgggcagacacagacacatgtgactatgtgactatgtgactatgtggccctggggcagagccaaggaggctctgatggcaggaggtggaatccctgcaggatgtggcaggagaattcctgcaacccctgcccagacttagttctcagagggtcacatgtactccctggttagccgtggccagagggccggggaataagccagaaaagacacctccaaatggcctctgcctggaggcccagctgtgaccacctcttaacacatgtctgtctgtgggtcaggagagcacaggatggggcacagtctgctggcagcaggctagcccgggcagcccctgagacctttgcagggggtgtccccaaaccaggtgtggcctgtgcatcgttggtttgggtggagcccggcagctctgcagaaggggaacagagcagggtggagagctgcagactcactgaagggaggtgagggtgcggttttctctcactgccactgcgatggcccgggcaccctggtcgtggaggaggttggctgtcaggctaggaggaagggaacaggagcaagtgagccgggggccggctgtgaagcctccggtccttggtcaccagggattccagggcttgataccagatcacccagccagcacgagggggtgcttcctggggatacgttgcccaatggcatggtaacatcctcatccatccccaccaggtgaagcagacggcgtcacactagcctcaccctcgtgcagtttacactatgagagtgggggacttgccacccgatgtcaggtctcctggctgcaccctccccagccagctccttctccaaccctgtgacgtggcgagggtgcccgtcagcccaggctcggtgtgggtgtggtcatggcatgaacagcctgtggagtcacaggcccccaccacgtactccaggttcttcagggtgctgttggcgcagagggcatgagcgatggcctgggctccctcgggactgatggagttttctcgaaggctgaaaaaaaaggaaagacctgagcttctgaccgggcagatgaggtgtctggcaaagccaagcccaggtgtttaggcttcttgaagcccaagaaactgcaggcgggggacctagagttctgcatagtctgggctgaggtgtgaaggagccagtgctagtgagccagtgctgggccagccaggtgcccccactttaggaccatccgcagtacagggagaggacaggatgacagggccccagaggtgcgaggggacaggtggctcagcgtgcatctgggaagggagcggcagaatgggccactgcgggcagcagctatcccctgcaccccaagagagcaggaaaagggccaggctgccaggaaggcttccccagccatagatttccctgagacaggcttcccagtgccaagtccctgcagacaggtgcctcgtcaaagaaacgccctgtttggagagggtggccaggacttacctgaggctgaggagggtctggttggtgcagagggcccccatcagtgctgccactcctgcgtcactgatggaattgctctgcaggctgcggaaagaggaggcgccctgggtgtggctgtcccaggacccagagggagctgccctgtcccagtctgggacagcaggcactgggctcaacagggagttgggggctccagggacagtggtggccacactgcttctcttctcatctctctttcctctcccagccccccaccttctagcctctgccaggtcagggcaggtgggttcagcacaacaaacccccaaatgtagaccctgccttgatgtgggtggccccagacagcctcagagcagggtgtgttgggtctgcagcccccagagggagtggcgcagcaggctccccaagtgtgggtgtagcgctgagctctcctttcccctaccaaagctgctgcagctgactccctctccagccacccatgctggcttctcaaggacacttggagctcatcattccaaacactccagaccctaccccagcccccactgtctagggaaatggagctggtggggcaggggctactgaggacagtgtgtgcccagggttagtgttggcagggaaatggccctgggggacagccatttttcaggactgccggcccactatctactggaaagagaacccagggggaatcgtcaccctggcaggtggactcactccaggctctccaggccctggttcaccttcagggcctcagccagggccttggcacctccatcaccaatactattactggagaacctgcaagagaagggatatggatgagccagcctctgggagctgccaggcagggctgggcagagggatcagagtcagggaagccctcctgggagggctggctctgttgtctcaagggtggccagtgcacagtttgttctgcctgaggcctgttggctgtagtctctgcaagtgaccacctgttgtctgtaagaaatcaggatagcaaagtccctcttgactccctggcaagaagggtcaacccttcagtgataagtattttggggggtttttgtgaagatggtcaggaaatgttttcttctgccagctgggaagacagtaaatgtgagcccgagaaggttggggttcacccagtcctgggaatctgagtctccattctcctcggttagtgcttttggagtccaaagtcagctaaccagcactcacacttccatccatctatccatccactcacttattgatttatctacttacccacccactcattcataaatccatccattcgtccatccatccacctactcacctacccacttacccattcatccatccactcatccatccacctacccatcagtccacttagctatcatttcgtctgtccatccactcatccacccatccatccatttgtccatccatccatccactcacctattctccactaattcattcagccatgcctccatccactcatctacccacccatccattcatctatccattcatccatccatccacccacccacccactcactcattcattcactcattcattctaccatccatctatccactcacccatccatccatccatccactcatccatttatccatccactcatccattcaaccatccatccattcacgtacccatccacctatccacccatccctctctacccacccatccacccatctattcacccattcaaccatccatttatctactctactcattcattcattcatccacatacccacccatccatccatccctccatctacccactcacccattcatccactcatttattcaaccatccatccatccatccacccatccaccaatccacccatcaatgcatccattcatccactcatccacccatccatccatccatccatccatccattcattcaaccatccatccatccattcaaccgtccatctatccatccatccttccattcactcattcatccactcagtcattcatctactcgttcattcaaccatccatccatccatccattcaccagtcctctcacccatccatccatccatccatccactcattcatttatccattcattcacccatccatccatccatccatccacctgcctacccatccaccactacccacccaaccatccatccacccacccatatactcatttaaccatccatccatctatccactcattcatccatcagtccactcatccatccatccgtccactcatcagtgtatcccttcattcatccatccatccatccatccatccatccatccatccatccatttacctagccacccatccacctagtcacccatccatccatccacccacccatccatccattcacctatccatcaatccatccatccatcctcaggctcacaaatatttgtgctgggttgggcattgtgctgggcactgaggatactagtgtgggcctttcatatgtctcacatgagctctttcagactcctgttctgcttcaagggcatctgccatccgctgggctcccatgggcccgatgctgttcttctgcaggctgtgggagaaaagagaggggtcctttagaaaggctggtcacagccattcccaggccaaggacggttcaggttcaaggtcagggacaactagtgtgccctctacatttattggagcaggtggggagggcgttctccagatgggtctttggattgttgcctaagtgataatggaccaacattatgatgagggatagtaaggggtcagggcagctgagcctcccttgcaaggagctagaaagcagagatcagtaggtgctgataatgcccagcaacctcccgaatggggacctccatggacaagtctctctggtgccttacctgcagtctgcctcccatctagaccagcaggctgcctccaaccctaagaaacctccctaggggccaggtacggtggctcatgcctgtgatcccagcaccttgggaggccaaggtgggcggatcacgatgttaacagatcgagactatcctggccaacatggtgaaactccgtctctactaaaaataaaaaaattagcggggcgtggtggcatacacctgtaatcccagcaacttgggaggctgaggcagaagaatcacttgaaccagggaggcggaggttgcagtgagccgagattacgccactgcactccaggcgggcaatagagcgagactccgtctcaaataaaaaagaaaaaagaaacctccctaggaagaccctggcttaggttcctcttctgaaaaagctgcttcctcttgtcctaaatctggtggagggagacagcacgggagaaaccctgtcctcatcctacaaggacaggcaggcaggacgtctcctgtgtgaggctaaatacaaatcctaaaaaatgtaattttccctggttccaaaaaggaaagagactccttaccaccctcattttctcagagcacttcctgagaaaacttgaggttgcaaatgctgcctctgtccctttaagatgtatgtaaatctttttaaaagcaaaatcagcctctggccactttcacagcctgggaatgtctttcataagggtttggagccatctctttgaaatgtaaacattaaggaacaaagagtccctccttccctgccttcgggaattaggctaggtatctggcttgaagctctaaagtacctgcgtgtcatagagataaaagctttacttttcctttggataaaagcaattagggaccacaaatggccactccaattatctgctgtatttaggataaacggcaaatggtgctgcctggccctcttgcctgaggacgagggtcctgtctgcttggctctagaaaagtgagctttctgtctttacagtctcattggtgggttgccccgatgcaccgtgcagtcagtttaatgtttatccaataattgttgtattctttcctacatctgtgggttggtagaaggtattttattttatattttattattttattttatattttaattttattttatattttaattttatttttttttgacagagtctcgctgtcgcccaggctggagtgcaatggcacgatctcagctcactgcaccctccgcctcccaggttcaagcgattctctcaacttagcctcccaagtagctgggactacaggcttgcaccaccatgcctggttaattttttttttttttttttagtagagacggtgttttactattttggcccggctggtctcaaactcctgacttcaagtgatccgcctgccttggcctcccaaagtgctgggattacaggcatgagtccctgcgcccagccaggaggttttatttttaattatttccccaacagctgctctctcgaaaagtaatgggcatcaggggccatccagatgggtcagaaggcctcaggtcctagccccatccattcttcctagcaggtaataggcagagaggcccttggaggaggagggagaagggagagaagggggagagaggagatgtgttcactcactgcagcatggagagggtccggttggaggccaaggcctcagccatggacctggcaccatcatccctaacggtgttgccctggaggctgcagagacaagaagaggctcatcactgatggagcagaagctggaacccaggggtctgaactctctctgcagtgggggcacctctgtggagcaaggggttctgaccactacgtgccctcaccgcccaccatgcagggagagcagtggaccctttgcaccactgcctggggcttaggtttttctttgagttgctaagcatttgcctgctggctgggaacaaggtgcttctgctctctgaataaccacaacaaagtcatcaattgccctcattacagctgaaagacacaggatccaagtgttggtgagaatacagagaaactgcaaccctcacgctgctggtgggaatgcaaaatggtccgctgtctgtggaatatggtctggcaggtccttaaaaggttaaacatgggttgaccatgtgacccagcaattccattcctaggtatatcctcaaaagaattgaaaacaggcactggaagtcgtattcaccaatgttcacagcaacgatattcatataaccaaaaggtggaaacaacccaaatggctgtcattaggtgaatggatcaacatatcatggtctgtccatcccgtggaatatgattcagccttaaaacagagggaagaggctgggtacagtggctcacacctgtaatcccagcactttgggaggccgaggtgggtggatcacttgaggtcagcaatttgagaccagcctggccaacatggtgaaaccccatctctactaaaaatacaaaaattagctgggtgtggtggcacatgcctgtaatcccagctactcgggaggctgagacaggagaagtgcttgaacctggaaggcagaggttgcagtgagctaagatcacgccactgcactccagtctgggtgacagagtcagactccgtctcaaaaaaaaaaaaaaaaaaagttaaaataaaatggaaggaagcattgacacatggtaccacacggatgaagcttaaaaacatcatgctcaatgaggaaagccgcacaccaaaggcgagcctatataaatctatttacatgaaatgtccagaataggtaaatccttagagatgggaagcagattggtgattgtgaggggctggggaaaggggagaatgggaagtgactgtttatgggtatgaggtctccttcaggggtgatgaaaatattctggaactggacagatgtgatggtggcacaacattgtgaatttgctcaatgccactgaactgtacactttaaaacagtcagggttttttttagacagagtctcgctctgtcgcccaggctggagtgcagtggcgcgatcttggctcactgcaacctccgcctcccgggctcaactcaacctcagcctcctgagtagctaggaccacaggcacctgtcaccatgcctggctaactttttgtacttttcttttcttttttttttttagtagatatgaggttttaccatgttggccaggctggtctcgaactcccgacctcaagtgatccacctgccttggcctcccaaagtgctgggattacaggcatcagcctctgggacccgcctaaaacagtcaattttatggtacatgaatttcaccctaataaaaataaataaataaataaataaataaataaataaataaataaataaatgaaaacagaacagaaaagtggtacccactcagctaagtatagatataaccacaggcttttaaaagagacataactggctgggctcggtgactcacacttgtaatcccagcactttgggaggccaaggcaggcagatggcttgagtgcaggagctcgagaccagcctggtcaaaatggtgaaagctcgtctctactaaaaatacaaaaaaattagccaggcgtggtggcaggagcctgtaatcccagctacttggaaggctgaggcaggagaatcgcttaaacccaggaggcagaggttgcagtgagacaagatctccagcctgggtgacaaagaaagaatccgtctcaaaaaaaaaaaaaaaaaaaaaaaaaaaaaaaaaaaagagacgtaacaaaccacatcacaactctgtcccctgctcaggccacacacacaggctcaagtctagggaagagctggaccctggaaacttgcgtagggcataagatccccagtacccaatgggatgggagccagtatcccatgcctgccatctttgtttgcttgcttgttgagagagtttcactctgtcacccaggctggagtgtagtggcgcgatctcaacttactgcaacctctgcttcccagactcaagcgattctcctaccttagcctcccgagttgctgggattacaggcacctgccaccacgccagctaatttttgttttttagtagagatgccatttcgccatgttggccaggctgctctcgagctcctgacctcaagcgatccacctgtctcagcctcccaaagggttgggattacagatgtgagccactgtgcccggccccatgcctgccattgtgaatcacctcccattctcataggtggtgcctgaggagagggttttctgggccctctcttggggtcacaacacagggagcaggtgacacacacctcagggaggtcagggtgcggttgatcttcaaagcgtctgccagcgccttggccccttgtggtccaatggagttaccgcggaggctgaaggaagagagaaagagacacctccttcatctgtctcccagagagggaaggggaaacagaaactgcattgaccttgaaattcgtgatcctctaagggaatgtgtaagggcttaggatctcatgtttggtggaaccagggcagagatccttatataaacaaggaaggagtttccccacgactgtctcaggtgttgggggaaagaaagcagcacctgatggactagtgggcttgggccaaatgtggagatgagaatgatggccccagatgcagggcaaacatctggtgtgtccctggctgtagcccggcaactgaggagccatggttcagcccggctgtccttctgccccaccaggaaggcatgtgcgctaaggtgtggcctccctgtgtcttattcccacaggagtcttagaacctgctccaaatgaagtatggatattatgtccagatgctacccaggggctgaatcatgggaatcagggaagaacagacaggtaagacccaagtcatttcctaggagggaggggacttcacaagatgcctcacaactcttctggttccaatggcaaaagttcggccttggttgtccttacttactccagagaggtcagacttctgttgaccaagagggatctggccagagctttggcccctttgttactgatctggttctccgccaagctgcccaaggaaagggagaggagtggttattttaggcatgcacatctcatggcctcttcctcaacgctgtgcccgtgattaatcctctaggctcccccacatcatcagggtctggacataggtggagatgaggtgacccctggagcagaatgccaggcacagcagagcccctgagcctgggcagcgtagggccagagtgggaggacagaccctcatcatggcaaagggtctcaggaaaaagtttaaccagaatccagcacaacagcttctacacaaacagcacagcaaagaaaatggaaatctcggaagcctaacatgcagatggcagccagtggtgtactggtaaactggctcccaggaaaaacaaaatttcaaaaactgggctgtgcgtggtggctcatgcctatacaatcccagcactttgggaggccaaggcgggagcatcacttgaaaccaggcgtttgagactagcctgggaaacatagggagatcttgtctccacgaaaaacataaaaattagtcaggtggcgcacctgtagtccaagctacttgggaggctgaggagggaggatttagcctagaaggttgaggctgcaatgagccatgatgacatcactgcgctccagcctgagcgacagagtgagaccatgtctcaaaacaacaacaaaacaaaaaacaaatgctagcaaactgatttgtagtatctgccactttccatggtataaatactcccagcaacaccaagttcaagcacctccaccttgcaaaattcctgaaaatttaacaatcagctttcgtgaactggtacaaacaaatttaggcacactactgatcctagcctcttttctagtgcaaaatggcaaatggtagagttatttaaaattaactttaaaattaaaaaaaaaccacacacacacacacacacacacacatcttgatttgcctcaaaagcatggttctgggaatatggtggtggatcaactcaatgttacttcatgtatccagctgcagaaatagtagctgtccaggctctttgccgtttgtaggcattcagccccatgggatatagtagttcaattagaatccccaggctggtgctcttctttttcttttttcagacaggatctcattctgtcacccaggctggagtgcagtggcatgatcatggctcactgtaactcgaactctcgagctcaagaatcctcccacttcagcctcccaagtaactgggaccagaggtgcacgccaccacacctggctagttttttaattttttgcagagacagggttttactttgttgccgaggctggtctcaaactcctgggctcaaacgatcctcctgccttggcctcccaaagtgctggaattacaggcatgagccaccgtgcccagcctggtacttttcaagctatattgaagcaaactgttcactggaataaagtctcttttctctaaattccttttcagagaacttcaattcacagcattcgtccaggccacctctgtataaatgttctcaaattctagagtgcttccatccctctgggacttttatggcattttataagttgtatttaacttctaggtgaaatagggatgtggcactgaggatcaactacagagagaggtaaagaagagcatgtggccagagaagagatttttggcttcattcagaataatttacttttatttttatttttagtaaagatggcatcttgccatatgtttgccaggttggtcttgaactcctggccttaaagaatctccccaccttccagattgctaggattataggaaggagccactgtgcctggcccccgaataatttctgagcactacctagtctgctttaagcaaaactaaaagttggctattttgtcatgtgctaaaaatgcaggaggcgctcacagaggaaaaaatattaataatgagaattgtcattcttttacttttctttttttttttctttttttttttttgagacggggtcttgctctgtcacctcggctggagtgcagtggcgcaatcttggctcactgcaacttctgcctcccagactcaagcagttctcctgcttcagcctcctgagtagcagggattacacacacccaccaccaccacgactggctaatttttgtattttttagtagagacagggttttgccagtttgaccaggctggtctcgaactcctgacctcaagtgattcacgggcctcagtctcccaaagtgctgggattaaaggcatgagccaccgcccctggcctagatatccttttaagcccatttttaccctcttaaggcacagaaatgacttcttcaaactcacacagagcctacacctctaaacatactccccagtgccttatttttgttactgaattagtgtaaattgccattaactcagataaagattacttcagaacccagaggcttgtatgagaatgaagaattacccctggccacagtggctcacacctgtaatcccagcactttgggaggctgaggcggatggatcacctgaggtcaggagtttgagaccagcctggccaataaagtaatatagtgaaaccctgtatcgactaaaaatacaaaaattagctgggtgtggtggcatgcgcctgtagtcccagctactcaggaggctgaggcaggagaattgcttgaacccgggaggcggagtctgcagtgagccaagatcgtgccactgcactccagcctgcccaacacagggagactccgtctcaaaacaaaaaaaaaaacaaaattagcccttgggttctcttctccaaactcacctccctaggtctgcaacagccaccctcagaggatcagtcacatcgattcaaccacaaaccccgagtgtgtgtagtttctcagatccaggaatgttattccaggagacgtttcataagcacacattcaccatgtgaacttttgtctaattacaagatgaaggtttttttgtttgttttgttcttttttgagacggagtctcactctgtcacccagactggagtgcagtggcgctggagtgcagtggtgcgatctcggctcactgcaacctctgcctcctgggttcacgccattctcctgcctcagcctcctgagtagctgggactacaggcgcccaccaccacgcccggctaattttttgtatttttagtagagacagggtttcaccgtgttagtcaggatggtctcgatttcctgacctcgtgatccacctgcttcggcctcccaaagtgctgggattacaggggtgagccaccacacccggccacaagatgcaattttaattaaaaattgtttaaattgatttaaaattaaatttgaaattaaattttaattaaattaaatttgaaatttaaaattttaattaaaaatgcaattggctgggtgcagtagctcacgccagtaatcccagcactttgggaggccaaggctggcggatcacaaggtcaggagttcgaggccagcctggttaacatggtgaaaccctgtctctactaaaaatacaaaaattagccaggtgtggtgggcccctctaatcccagctactcaggaggctggggttagagaactgcttgagcctgggaggcagagattacaatgagccgagatcatgccactacactccagctggggtgacaaagcaagactgtctgggggggataattataatcctgtgcctagaatgctgttggacagcaaacttggagaggtgcttagagaacattgtgcctggcattatgtcagcacacgtagtgctgtggaaacacctgcctgtgcacagcggtgtctagtcccgccaggtcacctccctcttcctactgatgaggcacctgagcctctagcactttctggaattgggcagaaacaagcaggctgcatctggagccacatgctccaaagacacttctccgtggcagcgccgctggccagctgagcagaggatgatgggaagagggttccataccccacaagaccataggcaccctggaggtcccctgggtctgtgttacctgatcttctgaatgcgacagtccttcccactcagcacgctgcccagcagctccatcacggggtcctggaactggttggtgtccagcctggccaaggggagcagtgacagtgagtgtcccacccgcccacgggcagggtgggggccctggcccggggcctctgcctctctccatcccatgcagcgctatcaccgcagctctgagatctgcgctcagccccagtgctcagacctttcccgtgagagtgaacaggaggctgggtgcccacgagacctgcggttcctgtgcagaacggcatcttccacgggctgtcgtcctcaccaccccacataccgcctgcctctgcgggacacctggatgaccctcagcctgtgtcctttcctccctactcactaaggtccagagtggcgggcaggggacaggctgaaagcattcagcgggtgtgcagcttctatcagactggatggttctgagggggttatgaattgaattgtgtccccacaaaagatatgaagtcctaaccccctgtgccccaagtatgtggctttattgagaaatggggtcactgtggatgtactttgttaaggtggggccatgctgaagtggggtgagcctgtaatccagtgtgacagtgtctttttaagacaagaaagcactggccaggtgcagtggctcaggcctgtaatcccagcaatttgggaggctggggtgggcgggtcacctgaggtcaggagtttgagagcagcctggccaacatggtgaaaccccgtctctactaaaaacacaaaaattagccaggcatgatggcgggcacctgtaatcccagctactagggaggctgaggcaggagaatcgcttgaacccaggaggcagcgtttgcagtgagctgagatcgcgccactgtattccagcctgggcgacagagcaagactccatctcaaaaaaaaagagaggacagcaccatgtggagacagacacagggagaagatgaccaggcgacgggagagactgaagtaacgcagccttaagccaagggttcccatcaaacactggaagctagagaggaaggaaagaacctctcctatatgtttcagagagcgcatggccctcctggcaccttgatttgagacttctggcctccagaactgcgagaaaacacactttagttgttttaagccaccaagttcatggtcctctgttacggcagccctaggagactgacagagaagcttggtggtggggaggggacggcttctgctctctcctctgccccttccccagcccctgccccctgccctggtatccacctgagcttccggcagtagagcagctggggcagcaggctctgaaggacgccctggctgaggctcagggacaggttggcctcctgggcacaggcgtcggacacctgcaggaggtaggccagggcagcgcggtgcgcgggaccagtcagcctggccagggccccgctctccatggcctcctccacgctgcgggccagctcggtgtgctgcagctcatgcaggcagtgcaacacgttgatggcccgtgcacagactgcggcatcggggcgcaggcagccctgcaggagctcagccacctgggtccggtaggcctggtgctcgccttgggccagcagggagccggccaggagggcattgaccctcggagacaagaggccggagaggaagcgcaggaacacgtccagcctcccgtcctctgcctgcatggcccgctgggctgcgctcctgaaatgcgtgaggaagcccagcctgggccaggatacgccgctctcagtgaagaggtcgaagatggccctcctggatgcgccatagtaatacgcggctgccacaaactcctgcagggacaggtgggtgaagcagtaggccactgacgatgccaacgtctcctctctctgcaggaagcagctgcacggggcgccctgcagcagagcgaggtctacaccaaacgccttcatgtcttgctcgtaaaacacgtatttcttcttgagcagcccatggaaggccagacggcccaatgtccccaccatcttgcggccaccatgggccacctgctcgatgcgagggcttgccttgcccttctcctgcccctccccgctgagggccatcctaaagtaccatgagtagagctcgcacagggtcctcgggggccacagctctgcatcctggggccccgtcctgctgcgccacaggtggcctagcgccatccccgtgagcctgcagaaggctgggacggtgcacatcaggtacagggccctgtcagcctgcacttggctcagcatccagcccagaagggcctggtcctcggggaacatctgctccaaacacaccttgatctcctcctcgttaaagccccggatctccgtcatccggtccaccaggccccctgggatctggccagatgcactgggacgggaggtgatccagatggaaacttccggaaagaggttgccacggatgatgttggtgatcaggtggtccaccgggatctccttctttgggtccgtgcaggccacggtgttggagaagtccagaggcgtcctgcactcatccaagccgtccaggatcaggagggccctggctgggactgccaccgccaggctgggctccccgacgtgcgggaagaccgagcagatgagtcggtcggcacacagcttctcgtgggtgttgagatcccggaaggtcagaggcagcaccagcgagaagtccttgccgacctgcccatgggcccagaggcggacgaagtgcctcaccagggtggtcttgcccatgccggccaccccgatagtgatggagacccggggtgggacagacacccgggagagaggcaggaagagccggtccagggcgacggtcctggcggggtgcccgcccccgcgggtggcctccacctgtgtgaagtcgtgttccctcagctgcaggtccgtcaggccctccaccagcaggagggaggccagcctgtgccagggtccgcccagctccgggccacctcccaccttgctcagcagggccttgcggtgcctctgtatccttgagtctgcgggacagaggccagtggggaggtctggtaagggaagagtgggcacaatcagcccaggtgttccccaccccgcgtctgcctcccaagccggtcctaccattgctgcagggccccagcggggcatccggtgtcctatccagggcctgcggggcctgggagccttgactgcccttcccagccagcagatccatgagggctttcacctgctcggctggggagcccgtaccgtggccctggccggcctccctgcccgtccgcacctcttgcttcctcatggagtcggggatcacctccaggagctgtgaagagagggcctgaacctgctgcctgccgtgccccccatccagcagcctgggacaggtgagcaagtccccaggaacggggtcagggatcccctcttcctctttcctcagcctttgggtggcccactggcctggcctctgagaatggactggaagggccatttgttcctgggtggtagcaatgatcacacgaatgcaggggcccagtggatgataactggggccctgagcttgtaccccggccctgccacttaccagataggtgactgagggcaggctgagtcacctctctgcgccttggtgtcttcatttgtgacctggaaatgatgatgaggttacaagtaagtttgctcaaaaggagggaggaatgaaagaaggtactctgttggaacatgtgggaaaaagcaaaaaaaaaaaaaaaaaaaaaaaaaaaaggcagcagcagccactctggggacgctacactgtgtgattctgactaacattctggaaaaggcaaaagtatggagacaggaagacagtgaaagaaagggtcagtgggggccaagggttggggaggaggggtgaatcggtggaacacagacaattcctagggcagtaacatgactctgtagggtactacagtggtgggtccatgtcattatcattatacatttgtccagacccacagaacgtacaactccaagagtgagcccatggctgggcacagtgactcacacctttaatcccaacactttgggagcctgaggtgatggatcgcttgagcccaggagtttgagaccagcttgggcaacatagtgagaacccatctctaaaattttttaaaaattagcctggtatggggtgtgtgccagtagtcccagctacttgggaggccaaggcagcaggatcgcttgagcccaggaggtcaaagctgcagtgagccatgatcacaccacggcactccagcctgggtgacagagcaagaccccatctctaagaaaaacaaaataaaacaaaaaacttaactcttcttgctcctgagttagagcaaaaagcaaaaaaaaaaaaaaaaaaaaaaaaaaagaatgagccagagtatacactatggacattgggtgatggcgacatgtccgtgtaggtttactgattataatcaatggaccactgtggcaggggacggtgatagtgacagagtctgggtgggggcaggcatggggtgtatgggaagtctctgtactttcccatcaatttttctgtaaacctggccagacgcggtggctcatgtctgtaagcccagcactttgggaggtcgaggcgggcagatcacttgaggtcaggaatttgagaccagcctggccgatatggtgagaccctgtctctactgaaaatacaaaaattagccggggagggtggctcgcgcctgtaatcccagcactttgggaggacgaagtgggcagatcacctgaggtcaggagttcaagaccagcctgaccaacatggagaaaccccatctctattaaatatacaaaattagccaagtgtggcagcacatgcctgtaatcccagctactcaggaggctgaggcaggagaatcacttgaacccgggaggcagaggttgcagtaagctgagatcatgccattgcactgtagcctgggcaacaagaacgaaactccgtataaaaaaaaaaaaaaaaattagccaggcgtggtggctggtgcctgtaatcccagctactcaggaggctgaggcaggacaatcacttgaacctggaaggtagaggctgcaatgagctgagattgcgccactgcactccagtcggaggggaagagcgagactccgtaagcctaaaattgctttacaaggaaaagcttattaattaaaaaaaggaaataaaagatagaagaaggaggagtcaaaaaggagaaaacgctggttctcagagcggctgtttttcttactatgttcctggggtctcctgggagtgcaggagctcctgggctcccagcagtgctgtttgccctctgctcgtggggattgtgatgcagagatgctgagaggcaaagccaaggccccccactcccatttgcctccttgttgccaaggctggttgtccccccgcccccacagccctcccacacccaagctgtacactaaggccgggaactcgcccccacccaccctgctcgcctcctcaccgtgcaccctggccacagcagcccctccagtggggccccaggaactcaatggatggggctcagccttccgttgtccacagttctaggagaaaaaacacaatgtggccagcagaggtgatggctcactgctgctgatggcagccctgcattcaaaaataacaccaggtgttgtcactgcatagagaagcaggttggaccccacctgtccacagggcatttccctggttctcaatgtttagcttgctgttaggctgggcggtgtggctcacgcctgtaatcccagcattttgggaggctgaggcaggcggatcacctgaggttaggagttcaagaccagcctggccaacatggtgcaaccccatctctactaataatacaaatgagctgggcatggtggtgggcgcctgtaatcccaggtactcgagaggctgaggcaggagaattgcttgaccctggaaggcagaggttgcagtgagctgagatcacgccactgcactccagcctgggcaacagagcgagactccatctcaaaaaaaaaaaaaaaaaaaaaagcttgctgtctgcagccctgggattcagcaggctccctggccttggattagcagtggggagcctagctttttctttctttcttttttttttgagacggagtctgctgtgttgcccaggctggagtgcaatggcgtgatctcagctcactgaaacttctgcctcccaggttcaagcaattctcctgcctcagcctcccaagtatctgggattacaggcacatgccaccacacctggctaatttttgtaattttagtagaagcagggtttcaccttgctcaccgggctggtcttgaactcttgaccttgtgatctgcccacctcagccgagcctagcattttaacacaggtgatgctttttatctggaaaatgataaaagaagcttagcaataagtaaatagtaaagtaaaaataagtaaaacagtaaagtaaaaataagtaaaataccatttttcaggcattcaggtcatggtgttgaagaagtaaggagtgcgatcaatttgaggttgctggcacccaggccagctgaactaacctggaacattaggaacaggccagggcaaggccagtctccttatgctgccccaaagcctgttcttttattcttctaaatgtcaaaaccaagagggataaaaaatatgggattttgggctaggcacagtggctcatgcttgtcattccagcactttgggaggctgaggtaggaggatcacttgagcccaggagtttgagaccagcctgggcaaagtagtgagaccgtagctctacaaaataaaaattaaaaattagccaggcatggtggttcacgcctgtagtcccagctactcagtaggctgaggtgagaggactgcttgagcctgggaggttgaggctgcaatgagcagagattgcaccattgcactccagcctgggcaacagagtgagaccctgtcttaggagaaaaaaaaagatgggatttgaattgacattgcctcatgtgtatgggtccatgtgggtaatttgaggtccttctttagatccttctgtaaaactttatattttttctcatctcggtcttgccagttccttatttgtatctaggtatttttaaaaacagtttttgtcgtatgatgaatattgttggtataaaagatgattgatttttattttattgcatgtctcatcaacatattaaatattcacattggttttcatcattttccagttaattttcttcaggttttcaaattacttcagcaaggctgggcgtggtggctcacacctataatcccagcactttgggaggccaaggtgggcagatcacttgaggtcaggagttcgagaccagcctggccaacatggcggaaccccatctctactaaaaatacaaaagttagctgggtgtgatggcgtgtgcctgtaatcccagctattggggacactgaggttggagaatcgcttgaacccgagaggaggaggttgcagtgaggcgaaaacgcaccactgcactccagccggggtgacagagagagacaccatctcaaaaaaaaaaaaaaattcttcagcaagaagaatttttatctctttatttctgaaaaccatatatatatatatatatatatattattttttttttttttttttttttttgaggtggagtctcgcactgtcacccaggctggagtgcagtggcacgatctcactgtagcctctacctcccatgttcaagtgattctcctgccttagcctccccagtagctgggattacaggcacgcaccaccatgcctggctaatttttgtattttagtagagatggggtttcaccatgttgaccagactggtcttgaactcctgacctcaagtgatccacccgttttggcctcccaaagtgctcggattgtaggtgtgagccaccgtgcccagcccaaaaactataactcttattttgaacaattttaccacattggccaggcctaccccttccttggagcaataaggttgttgcaggccttcttgttttactctagactagaccaggagtggttcttgcccaaactgttaggtgtgatgtttgtgacagatttctagttttcttctccgatagagaaagatttattttgttctattaccattcaaatactattatgtaatatttactgaaggcatactgtgttctgcatattctgttaagcactgtatttccataatttatttctcataactctcaataccattatttctcccattttacagatgaagacactgaggctcagagaggttaagtgacttgtccaaggatacacagctgggaagtgggagttgggatagaaatcaattcctcactgacaccagtgcgtgtgctgtataatctactgcctcttaaggtagtttacactttttttttttgagacagagtctcaactcctgacctcaagtgatccacccacctcagcctcccaaagtgctgagattacaggtgtgagctgccgtgcctgggcaaaattttttaagataaggaatatctgttaaattagcaaattactttttagcatatattgatataaacatatgatttatttctcttcatttattcaaccagcaaatatttatggagagcctgttgtatgttctaggccctggggatgtgaaggtgaccaagttagatcaagtccttgacctgcggtttgacgggtaagggataatggcaatggaaaggaaaacaagtcaataagcaaggcagtttctgctggtggttagtgctgtgagtggaataaactgtgagtgacaaagaagcctggaattctagggggaggaggagcagaggtggtaattggcggctggggaaggctgctgtgagaggcctctgagaaaaagctacctaggagtagagagggtgagaaagagtcatgcagagagctaggggagggacatttcaggccaaggaaacagcaagtgcttagaggaaatgttgctggaacatggtaagtgagcaagtggcaccaccccctcagggctggaaaagccagtcaccgttgttgtaaggagtttggatttgttctaagtatggaggggagccactggggggagtgacatgagcaatggatatcagatctctcctggaatccatgagctacactaaatgattttctgatattgaaccaaccttgcattctagaatacagtcttccatttgtattattaaatagaagatgtatatattccatatatgtaaaaaatgtgtgggctagcacaagaatagatacataagtcaacagaataggatatagaggccaggaacaaatatatatttataatatctacacattaaggagtttggtaacatgacaaaaatagcatttcaaatcagtgaaaatggcattggggcaattgaccagcctatgaaaaatattttccagctgtaattcacattaaacacaaaatttattttcaggtcaattaaggagttaaaagttgtaaacacaaaaccataaaagcacaataagaaaatatgagataatattttaaaatattatttaggtaaaggttttttacagtgagacgtaaaactcagaagtgtcagcctgggcaacatagtgacacaccatctctacaaaaaaaaaaaaatagatggggctggtggtgggcacctgtggaactagctatggggaggctgaggtaggaggaccccttgagctcaggaggctgaggctgcagtgagctatgattgtgccactgcaatccagcttgggtgacagagcaagaccctggctttaaaaaaaaaaaaaaaaagcagaattcatgaagagggagactagtaaatttgtcttaattgaattaaaatattaaataattaaatatttagtttgatattaaataattaaaatatttgccaggcgtggtggctcacgcctgtaatcccagcactttgggaggctgaggcgggtggatcacaaggtcaagagatcaagaccagcctggccaacatggtgaaaccccatctctactaaaaatacaaaaattagctgggcgtggtggcacgtgcctgtagtcccggctactcgggaggctgaggcaggagaatcgcttgaacccgggaggcagaggttgcagtgagccaagatggcgccactgcactccagcctgggtgacagagcgagactccatctcaaaaaataataataataattaaaatatttataagtaataatagatgccataaagttgaaagaaaaactataagccaggagtcaacatttgcaacatacatggaaaaatatgaatatccttaatatataaagaacttataaatcaataataagtaaccaaacagaattatgaaccccaaatgaaatagaaaaaaggacacagataattcatagaagtataaatgaccaagatattgaaaagatgctcagtgtcactaaggatcaagaaaaaagcaaaagaataaactatcatttttcatacgtctcattggtgaatattataacataacagactgcattggtgagaacatggaggtagtgggaaattttttttttttttgagacaggatctcactgtgtcacccaggctggagtgcagtggcatgatcagggttcactgcagcctcaacttccctgggctcaagtgatcctccaaagtagctgggactacaggcgcatgctaccacatccagctaatttttgtattttttgtagagacagggtcttgccatgttgcctaggctggtctccaacttctggggtcaagcaatcttcccaccttggcctcccaaagtgctggaattattggcatgagccactgtgccaggcctgtagtgggaatcttaattcatagtgggtggaagtataaattagtataacaattctggattataataaccattatctgttgtcattaaatatcttttgtcctagaaattccacttctgggaatttatcctaaagaaatatgtgggccaggcgcggtgactcacacctgtaatcctagcactttgggaggccaaggcaggcagatcatctgaggtcaggggttcgagaccagtctggccaacatggtgaaaccccgtctctactaaaaatacaaaaattagctgggcatggtggtgggtgaccgtaatcccagctactcaggaggctgaggcagggaattgcttgaacccaggaggtggaggttgcagtgagccgagatggtgccactgcactctagcctgggcgatagagcaagactctatctcaaaaaaaaaaaaaaaaaaaaatcaaatatctaggaataaatctagcaaaatttgcaagacctctatactgaaaactataaaacattactgagagaaattaaaaaacatcaaaaggagggatggaggctgggcaccatggctcacccctgtaatcccagcactttaggaggccaaggtgggtggattgcttgagcccgggagtttgagaccagcctgagcaacatgggcaaaaccctgtctctataaaaagtacaaaaaaaaaaaaattagctgagcacggtggcgcatgcctgtaatcccagctactcaaggaagctgaggtgggaggatcgcttaactcccgccgtcaaggctgcagttagctgagatctcactactccactccagcctgagtgatagagcaagaccctgtctcacacacacacacaaaagctagcaattatctaaacattcaaaggtatgtcagcccaaatgaagcagtgctactgtctgcctgatatgccagaggccaggatacggggtcctctgtccttcactgtgtgacattagggtgtggcccaggtggacacagcctcctgttgttggatgtccatgtgcacccaccaggtgaccagccctgctgctgggggcgggagtggccaggaggatgagaggactgcgtggaagaagtctcagctctggtagggcatcatttggggtcttattgattgattgatttaaaattttggtaaaatacacataacacaaaatttaccattttaaccattttaaaaataattttccttaaaaaatagaggcagggtcttgctttgtcgctaaaaaataaagacagggtcctgctttgttgcccaggctggagtgcagtggtacgatcttggctcactgcagcctcgacctcctgggctcaagtgattctcccacctcagcctcccaagtagctgggattacaggtacaggtgaggaccaccatgcttggcccattgtaaccattttatctttttttttttttttttttttttttttttttttgagatagagtctcactctgttgcctaggctggagtgtcgtggcactatctcgtctcactgcaacctctgcctcctgggttcaagtgattctcccgcctcagggtcctcagtaactgggattataggcacccaccatcaataccatttgtatttttgtagagacagggtttcaccatgttggccaggctggtcttgaactcctgacctccaaaagtgctgggattacaggtgtgaaccactgcgcccggccttgtggagcacggcttttaaataaccaacgctcggcctgaccacccagagatttgattggtctggcaagggcccccacgtggatctagtttaagctcctccggtggttctaaccagagttgagaaccacgggacccgagcggggctgggagaggaatgagggagggacagtgctggcaggagtgaggggttggggcgaggcaggactcacaagcgcctgggaaggcggggacggggtgtagggggctggcaagcacccctgcctctgtggcctcattagtctctcagtattgggagtcagcactccctcctgatcagacacccatctttgtggccccatgaccttgggtccagggttgccagattcagcaaattaaaatacaagacaaacctgggcacagtggctcatgcctgtaatcctagcactttgggaggctgaggtgggcagatcaccttgaggtcaggagttcaagaccagcctgaccaacatggcgaaaccccatctctacgaaaaatacaaacattagctgggcgtggtggtggatgtctgtagtcccagctactctggaggctgaggcaggagaatcgcctgaactcaggaggtggaggctgcagtgagccaagatcacgccactgcactccagcctgggtgacagagcgagactgtctcaaaaaataatgataaaatatgagatatccacagataattaaatttcagataaacgacatataatttttagtataagcatagcttatgtcatactggagacataccaaagaaatggattatttgaaattcacatttgaccaagtgtcctgtatctgatctggcatccctgctcaggccccattcagacgaaacgtggctttcatcctggacactgtccctaagaaggacagaggagggggtgcaggtgaaccaacccccctgccattgccagcacctcccaggaccagccccaaaggctgatgggggctggttacctggctgccaccgctgccaggccctgcacgcagccctaacatccccctggcaggctggagccttccacagacctctcagccgagtgaggtcgcgaggccgcagacgccactatggatggtcaggcggcccctgtgagcgcagctgaaagacagagagactgaggacaggtgggactcgggttgctttgggggatctgaaggccagaggtcgctccacagctggtttgagctgctgcgagcagggcgaggccagagggacgagtaggtgccactgctgcctcctccccgggagcctcccaggtagcaccaggtttcacccctagagctttgtctgtgagcgaaggtgaacctgaggccttcctggtgtggtgtgggctcaagcccagttcctcaggctcagcaagtggcctgctgcctcattcctgagaagcctcagtcccgacggactagccgcctctgcccatcacccgcccacctgatctgtgcctcagtccttgccgggacctgctgggtccttccctgccacttggcgcccgggtgggacttcccagtgctggctgcctacctgggctgccagtatctcccaccacggctgcttggatgctcctctcttcccacatcctgcccctgccccctcccagggccttggaattcaggactcggttctctcgaggtggccccagcatcatcacttgagctcaaaagccttcccgaaggaagaaggaagtggcacctgcacctcagggccctaccctgctcactgcatggacccctggagtccaaggggtggagaggcccagccctggggagcccagcaccctgggacagaagaagaggggtgcagcctgcagcctgtgatggccaacagtgagccccaggctcagggtcacctccagggaggggtccagaaaaacaccagggcctctggagcctggccataggggaagaccctgcagccaacacccaggctggcccagggcagtggcacttcttccgagaaggcctctgcggttgccgtctctctcgacccttgtctcacccaaggctgtgggcaggagaggccctggggctgcccactcgcctgggggcggcgcctgcaccctccctgcccctcatgacctcgcccctcctgtgctgtcacctccatctacaggtggggtgctgaggcccagagaagtagcctcccatggggggtcccagtgccaggaagggtgcccaggtctgccgattccccaggccgtggctcagcatcaccactgcctgcccgcagcaccttcaagatgcttcctgcttctcctgggccatcactggtacctgggggagctgggttttgtccctgggacctgtcctgggccattcttagttacctgttttttcttttcttttttgttttgttttgttttgttttggagacagtctcgctttgtcacccaggattgagtgcagtggctcgatctcggctcactgcaacctacgcctcccgggttcaagcggttctcctgcctcagcctcccgactagctgggtgggattacaggcgtctgccaacatgcctggctaatttattttttatttttagtagagatggggtttcaccatgttggccaggctagtctcaaagtcctgacctcaagtgatccgcccaccttggcctcccaaagtgttgggattacaggcgtgagccaccgtgcctggccacatctcttttttctacagcatgagccagtcctgccccaggagacagcttcttggagtctcgtggagtctccccagtccccctccccagagtagctcaggccttaaggccactgtccttcctgccagcatcccttctccctcccctgccctgcactgaggtcacctggacccaacttacctcccgggcctcgatgctgctccagggacagcaagactggggggcctgggggcgtccatctccatgctcctgggctcagccctgctccagctgcgtggtggtagatgccctgggaatccctgtgccagcctgagttctcaggaccagggatcagggcacttaccacgccaaccaaccaaccgtgtgggggccgagagcagtgcagccccgaccttctgcagccccaccgagcccaccggctgt

SEQ ID NO: 958 - DNA, 30403 bp, Homo sapiens
tttaataaagcctttttggtttattgcacatcatataaaactgactgcactgtatttgaaacagacgaggacattcacaaggatggagaaaccaaggtttccttctttcctggccctcatcttcctccacactgctcctgaggctggaggcagctttaacccaaagaatggaatccgctagtgaacatgtttgttttgtggtggcatcagagttgttctgggcccttgtgcactgtccagtttggagactgctggtaacaatgacaagtgtccgggtagcacggctgggtcaggagaactgcatctgggctgtggcagtgcagggagcctcaggacacctggtctcaggctggcggtggctggggttggcctgagtgctgaggaggacgggcccgggctgccggggcaggctggacctgacgtccatctcaggacagacatgtagggcagctgtgcccaggactggtgggctcagagggtggcaaatgtggcagaataggccatgccctggccagctggtgatggcccactgccccctgggacagctgagggccctcttgggttaagggagacacactgggccgggcgcagtggctggcgcctgtgatcccagcactttgggaggccgcagcaggcggattgcctgagctctggagtttgtgaccagcctgagcaacatggtgaaaccccgtttctactaaaatataaaaaatcagctgggcgtggcagcgtgtgcctgtagtcccagctatctgggaggctgaggcaggagaattgcttgaacccgggaggcggaggttgcagtgagccgagattgtgccactgcactccagcctaggtgacacagcacgactgtctcaaaaagaaaaaaaaaaagaaaaccaaaaagggagacacactgtgagcacggacagaggaaggggctggagtctgtaaatccagtgggtgacatgctccaaatgccaccctagaaagcagagcccagaggaggaagccctggattgggctgtggtcatcatcacagcgcagagctgatgtggtccccaggcccagaaatgcctgtggaggcctgacccacgctgggtgtcccaggtcctccctgcaaatggcgggggtgggggctgctgatggcaggttggggtggggtcgggatggccccatcagttccgctccaccttcttcttgccccgaggctgccgcctcctgccctggagcttctccctgcgggtggcggcagtggtgaaggtgatacagtgggtgtccaggaagtccaacagcctgcgcgaggacacacggaggccgttctgcctcagctctgcctgcagctcccgcagctcaaagggctggtacagcagcaccttctggtacagggccggcttggagcggatgtagcacctcagcgcctcgtctgtgtccgccgcctgcacggctgcctgcgaggcactgacctccccctcgccctcctcttcacctgcagactcaaatgccgctccaaactcacaggaggaagaactgaaaagagccagaccaggacgttgtgcaacccctttctctccagcccctgagaccatgagcctctttaaaggaaggaaggtgtctacgggtcccatggagcctggcctgtggcacgatccccagcaaggcaggacgggcctgagagatccctgcaggctacgccagcgggatcctgccccagccagaaatgtctagcatgtggggcaggaaccaggaggcctgcgcagggctggggtcagggaaccagccccctaaacccacctggttttcccacaggtcaaacccagaaggtgacgggggtttttgaagattggccattaggtctcactcgtgccaaccctcacgcccacgggccagaggatacatgaggccactgaccccatcgcatccatccggttacctctgtgagctcaaggagctgtcactgccatccacagaggtggccacggattcttgagaggctgggatctgggcgtcatcattgaggcctggaggtgcctccttggtgggcgacctgcttgggggtgtgatgctttcatgatgcttcctttgatgtcgggggcccttggtcttagcaggtcccttgggcctatgggccccaggtcctgtggtggcctcctgctgggcatggacccctgcccttgaaggcttgtaggtctgggaggcgagggtctggcagtgaggcgcctgcaacagcggctgtgaggactggctctcgtcctcggagtctgagtccagggtctggtgagtgtactggaatatctccttcagcttcagaaccatctggcgtttaggcagagggcggactccaaacctgacggaggaacaggtggatctcaggacccacccacacagctggtccacactccacgttccctatcttagcaaagagtgatacccaatgcattcagcgaatggcttgtgtgacaaaccatagatgcctgacttctgtgagcatcagaggttagtgtctattctaggcgccaactaagcttactctgaatattccaaaagaaacattgccagccaggcacaatggctcacgcctacaatcccagcactttgggaggctgaggcaggaggacagtttgagctcaggagttcaaggccagcctgggcaacatagcaagaccccgcctctacaaaaaatacaaaaattagccaggcgtggtggtgtcacctgtagtcccagctactagggaggatgaggtaggatcgcttaagcccgggaggctgaggctacagtgagccaagatcacatcactctactccagcctgggcaacagagtgagatcctgtctccaaaaataaaaaataaacaaaagatatgctgctcccagttctgagggatggtggcagcagcagcttccccgggtgcccgagtggaagagcagtgtcatgtggatgtgagagttaaatgttcttttaaaaaaaatcaggcctccgccgggcacagtggctcacgcctgtaatcccagcattttgggaagccgaggcgggtggatcacgtggtcaggagttcgagaccagcctggccaacatggtgaaaccccgtctctactaaaaatacaacaattagcctggtgtggtggcgtgtgcctgtagtcccagctactcgggaggctgagtcaggagaatcgcttgaacccgggaggtggaggttgcagtgagccgggactgcgccactgcactccagcctgggcgacagagcaagactctgtctttcaaaaaaaaaatcagacctcctcactcagactgctctggctagggggccatttccatctacatggaatatggggacctgctgcccaggggtgacatgcacgaatcctgtgtgttgcctccctggggaatggtacgcagagagaactgggaggctcaccccggcacccagcagtcacacatgctccctaaggagctgactgcagacctttcttcccaagcccaggccagctgcatccaccagacccagagaccacacggggggcccttccgcccccaggtgtgtgaaacccagttacttatgggagggaaaagaccactgtgggcaacaagctttgaagaccgccaacctatccagttccttcttcagcaccggcgtctccataatggaatactgtggcatcggcgttatgggcactttggggggcaagttcttcttccgattagcaccttctgggtaaaacaaaagaagcacacgttttagcatgagggacacggatttcccacatctgatcccagtagcgtgaccaagaggaataatgcacttgaagataacccaagcatcgttttgctccatgaaagcaacagtggtcaccccttccctgtctggagcaggggcttcccaatgatagcatcggtgacacgcactgaggaccacaccttgtataacacgggtgccgggtgaacagagctcctggggccactgaacccaacagcccggcacgtgactaaaacttatgcatgtaaacttaaaaatatctgacccacagtgacaacttgagacaatgggccacactgatactcttcaaacaggcttagacatcagttttgctttttaaaaataattcatcaatttaaaaaaacccagttaaaaaatgggcaaaggggccgggcgcggtggctcacgcctgtaatcccagcactttgggaggccgaggtgggcggatcacgaggtcaggagatcgagaccatcctggctaacacggtgaaaccccgtctctattaaaaatacaaaaaattagctgggcgtggtggcgggcgcctgtagtcccagctgcttgggaggctgaggcaggagaatggcgtgaacctgggaggcggagcttgcagtgagccgagatcacaccactgcactccagcctgggcgacagagcaagactctgtctcaaaaaaaaaaaaaaaaaagggcaaaggatgtgaacagacatttctccagagaagatctacaaatggccaataagcacatgaaaaggtgcccgacatcattagtcatcagggaaatgcaagtcaaaaccacagtgagataccactgcacgcccactaggatggccataacaaaaaacacagagggtttgggcaaaatggcagaaccctatctctacaaaaaaaaaaaaaaaaaaatacaaaaaaagttagcagggtgtggtggcccaagtcaccaatgtgggcagctgtttgtggctggttccagctactcgggaggctgaggtgggaggatcacctgagccaggaaggttgaggctgcagcaagccatgaacacgccactgcactccagcctgggcgacagagcaagaccttgtctcaaaacaataacaacaacaacaaaaacagaataacaagtgttggtggagatttaaaatggtgcagtcactttggaaaacagtctcgcagttcctcacaatgctaaacacagttgccatatgacccagcaattccactcctaagtacagaaccaagaagaaggaaaacatgtctacacgaaaacttgcacatcaatattcctaagtggcattattaataaccacaaattaaaaacaacccgtgtgtccactagtagatgaatggataagcaaaatgtggcataccatcagtggggtattagacatacaaaggaatgtatgcccaaagccagggcaacatagcaagacccagtctctactaaaaaaaaaaaattagctgggcatggtggcagctgcctgtagtcccagctactcaggaggttgaggtgggaggatcacttgagcctgggaggtcgaggctacaatgagctgtaattgcgccactgcacttcagcctgggtgacagagcaagacccctgactcaaaaacaggccaggcacagtggctcaggcttgtaatcccagcactgtgggagaccaaagtgggtggatcacttgaggttaggagttcgagaccagcttggccaacatggtgaaaccccatctgtactaaaaatacaaaaaaattagccgggcatggcatggcgatgggcgcttgtaatcccagctactcgggaggctgaggcgggagaatcgcttggacccaggaggtggaggttgcagtgagccgagatcgtgccactgcactctagcctgggcaacagagagaggctccgtctcaaaaaaaaaaaaaaagaataaaaaggaataaaatactgatccatgctacaacatgtatgaatcttgaaaactgtatgctaactgaaagaagccagacacagacacaaaaggccacatattagttatatatggctctgtttatatgaaatgtccaggacaggcaaatccatagagacagaaaggttcttggttgccagggctgggggaaggggaaggtgagagactgctcatgggtacaggatttttgagatgatgaaaatgttctagaattagagagtggggacaattgtacaacactgtgaatgtactgagaagcactgaactgtccattttaaaagggtggatattatggtatgtgaattatatctaaataaagctgttactttaaaaaataataggctgggcgaggtggctcacgcctgtaatcccagcactttgggaggccgaggtgggcggatcacctgaggtcagcagctcaagaccagcctgatcaacatggtgaaacccgactctactaaaaatacaaaaattagctgggcgtggtgctgggtgcctgtaatcccagctactcgggaggctgaggcaggagaatcccttgaacccgagaggtggaggttgcagtgagccgagatagccccactgcactccagcctggtgacacattggaaacagtcagactttggttcttctgccttttatgaccatggagccctttgagcccccgatgaaagcggcaggctctgtctcctgagaaaagcacgattcttcctgtggccgcagcgtcgtcctgaagcccacctcagatctgctgtgcagcctcctgcagctgttctcacagcactgcctgggaactggttagaaatgcaaattcttagtcaccctcccgaagcaaggctctggggcaggctgggccacgggcgtgctataagaagctctccaggtgtttctgaagcccctgagggccgaggacactatcagtggcctcattcatctggattttgggaggaaatgggcccccaggccgcaggcaggtgctcactcacagcctggcctttctcccagtcatgctcagcccagcccggcctgtccttgccctccccggaggtgcctggatgggagcagcagcaccgagggggccgacacctggggctctgactctccccggggactgaaatgagcagggaggtggcatccctgcacctgggaggaccaggaagaacaggcctaacagcctctcacacttgtcccacctgattctttttttaattgaggtgaaattcacataaaaaaatcgtaaagggaataattcagtggcattaagtattcacaatgttgtacaaccatcacctctatctatttgcaaaacattttcaccaccccaaaaggacaccctgtatcccataagcagtcactccccattccccctccctccaacccaggccaaccactaacctgcattttctctggatttgcctattctagacatttcatatccatgagtgcagacagtacatgaccttctatgtctggcttctctcacccggcagcatgttttctgggtcgtccacgcggtagcgtgtggcagtgcctcactcctctttgtggctgaacactattccattttctagtggtctagatggaccacgtttggtttccctgttcatctcctgacgggcatttgggttgcttccagcttttggcgattgtgaacagcgcttctatgaacatgcatgtctgagtccctgtttttaattcttttggatatacaggtaaaagtggaattgctgggtcctgcagtcaatctacggttaacattctggagaaccaccctggtccaatcttaaggcatgccgatacttgctgaatgagttgtggcctttggaggtgccggctccgtgttctggagaagggtccacagatgtggatttttaacacatgcccaggtgagcactggagccaggcaagtttgggaaacactgacttactggctgagaagtgtagcatgagaaccagcccggctctcctccactgtggaggggagtctggaaggcagcggaagtgtcatgcctcaggtcagcaggcattcagagggcagcccctgggtctcatgactgatcttcccaccctcttagtgtaaaatagtaacaaagacagtccccttccccagctctcctggctactcactgggtgtctctaacccttcgggcttctgagctccaccagcgcttggcatctgggccggaggaggggtctctggaggcctctgctcttccccgtcccaaacgtcccacagagccgaattcagaaagctcggcctgctattccccagggagcccgcgcccgaggacttctcttgcaatttcctctgggtagtgcagcttcctcggatgggggtggtgtccaggagtcccggggagcgacagtcacggctgtcggcggcctcgttcatcctgcggctggggctgctggtgctcagggggccggtccgctccaggttccagtggtcaatgggaattggcgagaggggctccatgtgccagcagcagtcgtcaattggaattggggggtcactgtccagtggggggcttctgttggcctgatgggaggccacctcctgctcatcgtcactgtctccgacttccaccacttcacccgctggggtctggttcaggaagcttggcccaggcggcgagtgtttcaggaaccgcctgctgaagtgggcgcggtcccctgagatgggatgtggagccagcggagaggagtgcgggtggcccccggggtggggacgggaagggcttctgtggccttgccttctgccgtcagaagttcctggagagacgggagtgaggcatgaggacggtgtctggggcggtggtgtctggggcctgatgacagaaaacttctgtgcgacttcgttcccttccctgtttcctactgaggccctgggcgtgtgctgagtcaccgcctgcacggccagcccgctcctgaggctgctgatttgggtctgggaagaacagtcacggcttctgctggccagcggggtggcgggcaccagccacgaggtgtctgtggtgctggcctcgctggggctgctctcacggtcacagaacagccagggagcccctctcctgcccaaagagccccgattctccggcagcgccccctcatcctcctgctgcagcacagcttcgcttcttggtgggctctgggaaggttcctgatctgcatcaacatcaatgatggaaaacagctcacaggacctagggctaatttctagagctttcttttcttccagaggatcactagaaatggacttcattttggtttgttctagctccagctcctcatccgagtccagtaagaggatgacctcatcttcttcgttcagtttggatgaagatttctgagatctggagctcgaatggtcaggatttgactgggttaggtcaatagacggagatttttctgggaacatcaggacccccttatttctgcactccagcacggaccgacgctctttgcctttctggtgccctggctctttagacagcgtgaggatgctcctgtcccttttctgctttgatggcacagctggagacagcaaggttggggagcccacctgggaagttccgccacgggaccggggtgttgacagggacgacccacttgtgtgatgagacccgcggggactcccgccctggggaggccccaataggaagcggcacgggtgcggtggagatgcctgccagggagccaggcgatgagaaacctccagccccctttccctgacagcgccactttgttcctcgggctcacttgttatttgggacggctctgagatctctccctgagttgatgagaagagctgttcgtaatccccggcatcatctgagtgcggaagagagccttcttttctctctgcctggcagtccctggaagggctggagcagctggaatggccaagcgcctcctctggcgcctcctgctcaggggcctctgctccccgtgcccctgagtgctggccctggggtggcgggagagcgcactgtcccatcttctcccaggtggtggcggcctcatctcttcctggctccaacggctccatctcctccaccttgtcccactgtttctgcacctggacacctgctaggagttgcccagaaaccggactgccaccctccagccagtcagcgtcctcgccggcacccgctgccctttcttcctggagaagctttcgctgagtagctgcaaattcataaatttcttccatttctgcttcattcacgttttcttgatcttcttcgtggtccttggatttcaacaaagtctccgcttcctcctcttcatctgcccacattgacctcaagagttcctggaaattctcggccctgctttcgcaattctctgcttccttctcctcccatggtttgccctctgagtcagtggcaataggcacctgttcgcacaggtgaacgagctcactcacgccaaacctgcaacacgaaacatcgacagtcatcgcccctctgcgtggagatgggctctgggtgccccggtggggtggcggaccagagcagagtcttcaccaggaggaatgaccatgacccaggccctgcttccctttgaagacggtgtccacactccttgccagaaacacccaggccacttagttccagaaaccggggactgacaacacttaaagcagggcttcctaactatagctgcagacataaaggggtgtgtcggactgaatgtaaggtaacagggattggcagagctacaaaactggggagtctgtgctgcctcagaggctcttaagatatggtgtcagagccaggcattgtggctcatgcctgaaattccagcactttgggaagccgaggatcactcaaggccgggagtttgagatcagcctggacaacatagaaagtctccatctctacaaaaaaatgtaaaaattagcctaggagttcaaggctacagtgagctgtgatcatgccactgccatccagcctgggcaacagcaagagactctgtctctaaaaggataaaaaaggtcatgcatggtggctcatgcccataatcccagcactttgggaggcggaggcaggaggattgcttgaggtcaggagttcaagaacagcctgggcaacacagcgacactccgtctctccaaaaaataaaaaataaatgaaaagacatggcatcagacacaatccacagcacaccaagtccttgagtcagcccaggccaacgggcaagccagccagccacctgcttgaaggctctgtggcccgtcagtatatttccaactccagaggctgagctgttcctttcctaagaaagcagcggagggaggacgcaggctcggatcagcggcccaggccctgtccagaggcacaacacttgtccctctgagctgctgcctctctcctaagatgctggctggacaagccaggagagctgtggcatctgggatgcagcctaagcattctctccatgcctgttttatgggactctggaaaggactgctgttgttcaggtctagtggtggaacaatcactgagcagcagtgttggggggcgctgtagccaagggccattctcttatcacacctagggggttaaaaaccacgggactcaatagagtcctcctgatccagtgcttggcacccctgcaagggtctgttctggcctgactttcacctaacatgccctgttccacagggtcatcactggtcatggacttgggattaaaaggtataaacaggactgttagttctcttggcctcagccccgagccctctgcagcacaaccctccagagctgttaacctgccagtcctcgtcagttaatttcaaaagctggggagcaatccagacctgtgggccagggagctcagctcagagctaaggccaggaggaaggccagtgtccgcagtgtagagatagtgcaggaacgtgcgggcggcctcggtgctcacgtcacccagcaggacacgctgggtcagaaccccgtcctctacagcggagaagccttcattgttcacctgcaggtgaaatgcaacacagagggtttactgatcagagagttgtaacttggagcaaagcagacggtctggggtgtcctgcaagtcactagtctttttatttttctttttagagacagtgtctccccttgtcacccaggctagagtacagtggtgtgatcatggcttactgcagccttgaactcctaggctaattttaaattttaattaattttattattttgagttggaatctctctctgttgcccaggctggagtgcagtggtgagatctcggctcactgcaacctccacctcctcggttccagcgtattctcctgcctcagcctcccgagtagctgggattgcagccgcccaccaccatgcccggctaattttttatagtttcagtagagataaggtttcactatgttggccaggctggtcttggaactcctgacctcaggtgatccaccctcctcggcctcccaaagtgctgggattactggcgtgagccactgcgcccagcccctaggctaatttttaaatttttttgtagagatgggctctcactgtgttgttcaggctggtcttgaactcctggcctcaagcgatcctcccaccttagtctcccaaagtacggggatctcaggcatgagccgccgtgcctggtccctagtcttaaaagcagctccatgccccaggaaaagcattagccactgtttatgcagatttttggccaataattttacaggtgaggcctaacactcctcttttgtcaaatcgtattgggactagatattccaggaccccgttaagagtcctcctgatagacacatatgggatccagaactttgacaaagactgagaatagctccctgagttcctgcccacactcaagtcaaatgctttcaagtcagaaggcaggttcatcagcaactcatccctgaggagatcaattatgagcctttgtaattatgcaaatagagaaaagagaaaacaattctgggaaacaatggattttctttttgttttgttttgtttttgagacagagtcttgctctgtcgcccaggctggagtgcagtggtgcaatctcagctcattggaagctccgcctcccaggttcatgccattctcctgcctcagcctcccgagtagctgggactacaggcgcccgccaccatgcccggctaatttttttgtatttttagtagagactggtttcactgtgttaggatggtcttgatctcctgaccttgtgatctgcccgcctcggcctcccaaagtgctggaattacaggcgtgagccaccgcgcccggccaaacaatggattttcattcaacagaacgaaaacactgatgtttcccagttgtgaggccatcccctcacacccactcctaacctcaagcgtgggtctttatctcttctccacgtgttgcagaaacggatggttgggagggagaaggtgagaacatggtggggcaggaagtgagggagagtgggggggtggaaagggcacctgagacatgggaagacctggttggagaaaggcaggaggagagagggagagagaggaaaggagggcacacggcagcccacgtacttacatactggatgaggagcgggcatcgggcataaagcacgaacttgtgggcgtaaagcacctccccgctgtccgtctgaaactggacatcactcaggtgtgggttattgaccatggcgccaaagtcagcaaccagcagcccgagggagagctgaagcaggaggagaggaagagccgtcacctccccacctctgctctgctaactgggcagtgggaagctccccgcatggaggtggcgctagggtgggccgggagccaggacctgcattctcctttcctctccaaaacgcttcccacgatggcctcaacctctgagtgaccctaaggccctgagtagcacagaagagcaaagcactagcttgttcctctggctcttgccagtgggttccctggcccccgtggagatgccagacatggggctagatgtgaactcacagtgctggcagctcccgcactgagtgggacaggctgcgggatacctgggctttgaggaggtgcacccatcccctgtgacggacaagcaccctgagtccaagcagctcggggacctggccaagaggacagccgggtccagtctgtgatgatgtccctaggctggccttggcatgaagtgcttggttgacactgacatgcaaatgggaggaggtccactctagggaaaagccagttcccaccccggttcttccccagacagcgcactgacagggaggccaggccaggctgctcagctgtgctctggagcccaggacccgcacagaggggagggagagcaagcccttggtgagctcccaactactgaggaacgagcagagcgtgcctggatggggcaaccgcgctgagaaactgtggtccctctacactcctgggacccaggacagggcaggctctggggcctcaaccccaaggtgccccatggagtcacagacagaaaaggcagaagtctcgtggcagagcccccagaggggcgctgaggtggctgtgggtccgtggctctgctcacggatgtcaggatgtggcagccttctggaaagcagaggccttgagaggccactgcacttgcgttgggggccagaggccagcggtgagccaaccccaccacacacatggcaagtgggatggccgggaccagagagcgcgggccagagccagttcttaccaaggtgcggccgcccctgtccgggtgcttgtcctgcgatggcaccacaaacccagtcagaggaaggccgccgggcaccacgtccaaccctgagtggaggattcacaggttaaaggaacgtcacagcccagccacatccaccaccaagaagacagcgttgaccacaggctgagccagcccctgcggtgcctcggaaggtgcttgctatccgaggacaccttcatgcaaagcaaacccgcacaccctgtctcaccaccactccaccagggaggtaagagaagagcaaaacagacagttcacccagaggattcactcgctgtgggcagacagctctgtctttggttaaagtggaaggaaaatcatgacagagttgtctacaccacattgacctttgagaaaaaatgaaagcgcccagaggctgcgtgttctcccaccaggtcagagctgccgtcgcggcggcacaagagccagtccatggcagcctcagccgcggggaggggaggcccgggagggcagggctggccctagagtcccacccagcatctcacctgcagtcccttccgagccagccaggcccccactgccgggccacgggctggcgctcagtccctccctcgccaggtccacgaggtcctgcagggcctggtgctccctctggctggccgaaggcgacgggcccctggagccacagcctgcagtgggggtgccgtggagagcgggtgaccttcgctcgctcagctctgagtgctcaggtggcaccagaggcggcacgggctcctgcataaggccctgaaagaagccagtaaggagagtgaccacgtggtcactgtcattgacgcacacactgcagaagccatcacatgtggtatgcacggctggacctaaaactacagagcaggatgtgggctgtggggacagactgtccccggggctccagccacagcctggagcagtcctgggatgcttttccccagcactcatgtcaacatgctcctcctctgtcacggccaaggccaggcctgtggcatctgtttgcacaaaggcttgtcagaggccaggggggcccaggcctgccgccctcctgaagtcctccaagctgcctcaggcagctgcgtactgactgtagggctacctgccgcacgactgtctggagtgtgtgctccgaatgccagtttccgggctccatctgaggcattttgccagttgccctgggactctgttttttttttttttttcaagacagagtctcactttgttgcccaggctggagtgtaatggcacggtctcggctcactgcaacttccgcctccccggttcaagcgattcttctgcctcagtctcccaagtaactgggattacaggtgtgtgccaccatgcctggctaatttttgtattcttagtagagatggggtttcaccatattagccaggctggtctcgaactcctgacctcgtgatccgcccacctcagcctcccaaagtgcagggattacgggcgtgagccactgcgcccggccgggactctgcattttcaacaaactccaggaacacactctggtggacaccaagggtcctccctgatcctacccagagtaccatgtagttgctggacagagaagaaagctgcagccaccaagtgcccctctggcctcctcccgcctctgcctttccttcctggactttccatcacctggctgtgggtacccagtgttgcagttctgggattgccaacctcccccaaaagcctatccatgtgcctgaggggagggactcacctgggcaggccgctggggcacgagaggagggaccagcctggccgtgtagaagtcctccatggcccaggccccagtcagtgcgctgccctcccacagaaagctctgcttgcgttcaggtggaggaggacactggcccgctctttcccacccttcctttaaaatcctgctggcaggaagtggtggcgtgctagacaattccacttcctcagagaggagcagggccacacggtcctctatctgtcggcctgtggtttcagagtcctggactaacaacaatgggggggataccgggggtttcttcttgcgacttttattctctagagagaaacaaaagcgacaccatcaacggtggagtcggtccactcacccgggacctgctgatggcctctcccagggtcactcttctgatcacacaaacctgcttctggtcttatcctctcagaaaaggcactttccagcctgagcgctggtacagccgcacccggctccatctccgaccgggacagagccatggccaccagcaggtcctcggacggtgcctcgtccaccttccgcctcttccgtggctccttcttgctggtgggtcctctccgtttcagacctctactgtgatcactgaagctagaaaacagccaaagagaaaagttactggggctagaggagtgcacgcttctcaggttggtcacactggtctggagagggctgggcctgagagaaaagtgacggatgtggacctgccaggcagatgcgtcccccacttccactgccttgtgtgaactcattcaattccaggccagaagttcaacatggcccaggcacaggagggtctgggttccttcacgtgctgctgtccagcaggctcatggcagatgtacggagccatctgtggtacctgcacatcctcatgtggccaagcccatccaatggagtcaacaatcgatggctctgagcaggctccctggactcccaccaccttcacccatcaatacttccgatgctccttacacggtcctggccacaccggcagaaaaggatcccttccctcctgcaagggctccacggcagtgcctctgtccatggccagaaggaagggcttcccagcttaggctgccgatggtcaacattataccagccgccccgggactctgcactttcaacgggcagcagctcgtttggtttggaggaaatgaacaggagtttccggctggagagaacctaggctgcctgggtgactcccaataagctgggcaagaaggaggagggcagaggtgacaaaggaacttagcacaaaccgggcccaccttccctgcaatgcagtcatgcctctggcttttgcaaaagctcatgctctccagggtgccagggatggctcaagttcaccttcccaggaacgtggataatcacagcctcccagagggaaaggagctgcctgggcagcctgggaccctgcttctgtgaagggaacacagactgtgttccctcctcactccccagcaggccaggtttgggctgtggggaaagaatatgaggcactctggccggggcatgcgttctgatgaccacaggcttggcctttggggagggaggggttcaaagaccccatgagggcatccagctcctgtagttttctactctgacaaccttctaaacggatccacatacatctagtttcagtacttggaggtattctaaaggcagacatactttatctgagcaggtgcttttggcgtggtcctgccaagaaagaaacaatggcttagatgacgtctattctaaggcctcaaggcttgcacccctgccatgctaaatacagatgcgctcctccaccaagagaatcccctctgccctctgccatctcagccccgagccagctcagctgcccatgacctgtgtgcaaagcagggggcgggacaaacagctatcgcctttggccttccctttgctcctgacagcggtctcaaacctggaggagtcaaaggtccaagatgcctttgttcactatgaacctggtgtcagctctagcgtcctcagcagcagggcagcgtggagcagggccagccctctggcacttgtgtggctgtggtttgcatgctgaggacttgtttcctggctgtgagcaaggcaactcattttaacttttaagcattaattcatgcaagatttttaaaaaatagggtcctacacttctgttgcaccaactttgttgttgtttttgtttgttttatgaagacaggttcttgccctgtcgcccaggctggagtgcagtggtgcaatcacagctcattgcaaccttggcctcccaggctcaagtgatccttccgcctcagcctcccacgtagctgggactacaggtgtgcagcaccacagccagctaattttttaattttttgtagtgatgggtcttgctatgtagtccaggctggccttgaactcctgggctcaagtgatccttccgccctggcctcccaaagtattgagattacaggtgtaagctaccgtgcctggccaatcaccaaatctgtgaactgtgctgagtaatcttatgttaacagtgtgaaaactggactgtgctgaggtggaaaccatgctgtccaacaacgaaatggatggagtaaagtgactaccaaattcttagatgtggtaaagcagtagtccccaacctttttggtaccaggaactggtttcatggaagacaatttttccatgggacaggagtaggggaatggtttcagcatcaaagcattccacctcagatcatcaggctttagattttcataaggagagctcaacctagattccatgcatgtgcggctcacaacagggtttgtgttcctgtgagtctaatgccaccactgatctgacaggaggcggagctcaggcagtaaagcttgcctgcccgctgctcacctcctgctgtgtggccaggttcctaacaggccacagaccggtactggtccgaggctggggggttggggacccctgcactagagggtaccgactgtgggatcatgggattggaaactcaggaaggaccttgaggaaaacagtgcgaagatcatttctgcacccccctaaaggggcaggtccagagccttccagaatgcagattctgtcccctcctcactcccttctagactgtgcccgatttccgccctaagtgtttcatttccagaatcaaagagggctctttttccctccaacactataaaaagctttttttttttttttttttttttttttttggagacaggatctcactctgtccaggctggagtgcagtggtacgatcttggctcactgcaacctctaccttctgggttcaagtgattctcctgcctcagcctcccaagtagctgggactacaggcatgtgccaccatgctaatttttgtatttttagtagagacgagattgtaccatgtcggccaggctggtatcgaactcctgatctaaggtgatctgcccaccttggcctcccaaagtgctgcgattacaggtgtgaactactgcgtccagcccataaaaagcttttttaaatagaaaaagccctgagtgcacacagcattatttggcttggttttcttccttttcgtcgacttacctgaacatgggtgggctgctgctaccctcaggctgtgctgtctgcagccgcacagcctgaagcaggagctgggggccaacctccatcttcacagcacactgcttcaagtgactggttctgctctttaaggtaagaaacggtttcccacaaatcgggcactcagggatctgaggcacagaaggtcttagtgtcttttcagcttcatccaagcacctgaaggaaaacagtcaatacaggagaaccaccctccccaggaatgtggattggagcaaatgtgggtccaggtcaacacagacgtgctgtggtcaaagcaagttccccaaagccaatcccctctacacagcctggctccgtctcccggcagtcagcccctagacactacacttaggtatctgtcagcaaagttggctaaagaaagcaaggaaagattaaatgcagttacatgatgacttagaaattccactcctaagtagagaccccaaagaactgaaagcaggtacccaaacaaatacatgaaacccatgttcacggcagctctatccacaatcccaaagggtagaaatgctccaaatgtccgccaatggacgaaaggataaaccatggtcatattcctcatctaagaatgggaaaaacacagtctagccatacaatgagatactgctcagccataaaaaggaatgaagcctgctccatgctacaacatggatgaacctcaaaaacaacatattaagtcaaagaaggcagacacaaaaggacaactgtgcaatttcagaatcggcaaatccatccagacagaatgttgattagtggttgtcaggggagagaggggcaatagggagtggctgccaatgggtgtggggattcttttgggggtgatgaaaataatccagaagtgattgtggtgacagttgcccaactgtgtgaatatcccaaaagtagtgatttgttcagtttaaatgggtgaactatatgttctgtgaattgtatctcaacgaagttatttttaaaaaggggtaggttgacaacaaagctgaggtgctgttgtcatggtaaggtgtggagatccgcactccagccctggggtgcttggggattctggtcacatacacgggagaggcgacggcccaagctgcccccacctgttcacatgctgttcccttcgggtcacgttcatggctgagaggttcttttgacaaatctggcagaagaacaaacccttttcctccaggctatcatcatgtgccgatgctcctacccgtgcaaactcctgctgcagggtcaaggccaccgcagcgtcgctctctggggcagggggcccaagcccatacactgtggagaagcaccaaagatccgtgagaataaactccaaagacaagctcaccctcagacctctgctctgtcagctcctgcagaccatggggagcaggtggaacgcaaagaaaccagaacccagctccactctgcaggctggtgacttggacactgtccagtgagactgggcactaatcagcactccgggaacagccgtctccaactttaacatggatatgcattacctgggaagcttgtcgacactcagattcaaattcaaggggtccaggtgcagcctgagactctccgcatttctagcagcctccaggcttggcgatgctggcagcacaggaccactctgagtagcaaggacctaaactttcccacttctgctgaagttggctacctcgggcattgcaagttcacaaggctcatattccaacaaagctagatgttctcttcaaaactcaccctttcctgctgaccttttactgcccatgataaaaccagggcagagtgaaatgcctttggcgtttaaaaggcagcatctcttacttagcatcagactcaagaatggactgattctggtcttgagatggctcccagggtggcccatctgatattgctggagcagacccctgtcactcacaagggatatgccctgaacgcctcataaatccccaagttcttcatggctgtggcctaccagtgcctgccactgaggccagcaaaacagcacaccttcattttggtgccctgttttgtttgtttgtttgtttttgagatggagtctcacactctgtcgccaggctggagtgcaacgacgcgatctcagctcactgcaacctctgcctcccgggtccaagcgattctcctgcctcagcctcctgagtagctgggattacaggtgcccaccacacctggctaatttttagtagagacagggcttcaccatgttggccagggtggtcctgaattcctgacctcaggtgatctgcccgccttggcctccccaaagtgctgggattacaggcgtgagccaccgcgtccagcctggtttggtttcttaacaaacaaatggtttatctctttctgagcacttgctgggtgtgatgtgaagatacagagagaactgagtcaaatgctgggcaggggcggagctcacaccagctgggtgcctcctctgcaactcacatgtgcgtccaggactgatgcctcggcaggacatcaaatcactgcctgctgtggaccctggggtggcctgagactcctccgtgctactgcagtgaaatctgcaatgcaatgccaagatcctgcatacttattagctgtaggtctgccgataatggtttcttcctatttcttttccttttgtatattttcatcagagatgagaatccatattgttttggggatggagaacaggagcacctggcattattacgcttattgggccggtgccacaccaagtacacagcagctatggggcactgtcgccaccctgtctcacctgcagccaatgagcctctaatctactcagagtggggcaacccaatggttagaggaaggagttaacgatcccataaagaaataaatccagaaagtgggaaatcttataatacaattagcctagcctcttcaaaaactcagtgtcatagggctgggtgtggtggttcacacctgtaatcctagcactttgggaggctgaggagggcagatcccctgagctcaggagttcaagaccagcctgggcaacatggtgaaaccccatttctagtaaaaatacaaaaaaattagccgggtgtggtggtgggtgcttgtaatcccagctactcaggaggccgaggcacgagaatagcttgaacctgggaggcagaggttgcagtgaaccgagattgtgccactgcactctagccaagcctctgtcaaaaaaaaaaaaaaaaaaagtcagtgtcatggaaaacaaaaggaaatgggggactattctagaatctagaccttaggatactgctgagctacagcaatatgcagtgtgtgaacttactgaatccttgttcagaaaaaaaagaaaccagctacaaaaaataaccttgagacaaccagggaaatttgagtttgaactggacgccaggcactattatggaattaagcgtgctaatggtattgtggttatgcagcagaatctaggggtaaaggatcctaatgtctataatttaccttcagataatatggaagaaaaatatgtacgcttggctaggcacggtggctcacgtctgtaatcccagcactttgggagactgaggtggacagatcacaaggtcaggagttccagaacagcctggccggcatggtgaaaccccaactctactaaaaatacaaaaattagctggacgtggtggtgcatgcctgtagtcccagcttcctggaagctgaggcaggagaatggcttgaacccaggaggtggagtttgcagtgagccgagattgcgccactgcaccccaacctgggagacagaccaagactccatctcaaaaaaaaaaaaaaatgtatatttataaagacataaacaaatggccaaatgttaacatttgttaaatctagattgaggtataggggattaggggattcattgtaatttttttttttttttttttgagacagggtctcactctgttgccctggagtgcaatgatgcaatcacagctcactgcagctcaacgtcctgggctcaagcaatcctcccacctcagcctcccgagtagctgggactacagttgtgcaccatcatgcccagctaattaaaaaaaaatttttttttgagtcagagtcttgctctgttgcccaggctggagtgcagtggtgcaatctcggctcactgcaagctctgtctcccaggttcacgccattctcctgcctcagcctcccgagtagctgggactacaggcacccaccaccataccttgctaattttttgtatttttcatagagatggggtttcactgtgttagccaggatggtctcaatctcctgaccttgtgatctgcgcacctcggcctcccaaagtgctggcattacaggcgtgagccaccacgcctggcccctaaaatttttttgtagagatgggggtctcactatgttgtccaggctggtctcgaacttgtgacctcaagtagtcctcctgccttggcctcccaaagttttgggattataggcatgagccatcatgcctggcttcattgtaattaaaacaacaacaacaaaaaaaccttttctgaaaggaagagttctttgtgaatactgagggttatctttttaaaaggaaaaaactgaaagggaaagctttcataataaaaagtcataatttttaaaaaaaggaggccaggcacagtggctcacgcctgtaatcccagcactttgggaggccaaggcgggtggatcacgaggtcaggagatcgagaccatcctggctaacaaggtgaaaccttgtctctactaaaaatacaaaaaattagccaggcgtggtggtgggagcctgtagtcccagctactcgggaggctgaggcaggagaatggcgtgaacctgggaggtggagcttgcagtgagctaatatcgtgccactgcactccagcctgggtgacggagcgagactccatctcaaaaaaaaaaaaaaaaaaaaaaaaggaagagggccaggtgcaatggttcacgcctgtaatcccagcactttggggagctgaggtaggcagatcacttgaggtcaggagttcgagaccagcctggccaacttggcgaaaccctgtctctactaaaaatacaaaaattggccaggtgtggtggcacacgtctgtaatcccactggctggggcaagataattgcttgaacctgggaggcggaggttgcagtgagctgagatcatgtcactgcactccagcctgggtgacagagcaaggctctgtctcagaaaaaaaaacaaaacggtaccttatcaaggaagctaggtgggaaatgatcccagagactcttcattctctggctggatccagtgaagtggcaaaggtaaaacatcaagcagagagcctatccacagaagaaactcaacaaatgctgattccttcccgcctcccttcctcagagttgtattaacttatctctgtgtggaagacagaaacacactcatcataccattccccgccatcatctcctcttgaggatcctttgggacattttcttcccgcgcagcctcgagggagcactcttctgaagcgtgtctcaaacgctcggggtctgctctcttgaactgctgcattcgctgtaggaccaattgtgctgtgcggggtttggagggacttggcactgctgttgtcaaacaggaaggaggaggctgggagtcgctgttgggcacattctctggcaaggaggaaaatattcacaaccatctgttgtagctggagaaataaaagacttttctaccagatacaggttagacgcaagtttcaagagtcctttatcaactagtttaggtttgactcacaaatgtgaagaggactggttgcttgttggtaacctctttgtttatggcaatatagacataaatatcaataacaggaggggaatgggatgtgactgctaatgagcatggggtttatttttaggatgataaaactgttctaacgttaggtagtggtggtggttggacaagtctgtgaatatactaaaaaccactgaaccatacccttttaaatggtgaattttatggaatatcaattataccccaataaagctattattaaagaaatattaatgacaaaggtttatgtcctagatcagttcttctttaacttgggatccacggatgatcttcagtggggatccatgaaccccatgaagttgtgtgccagttttgcagatacgcgcatggatacgtgttttgggggaaccatgcatagatttcatccgactggcaaagagcacgagagaccagtaaagttggtgaggcaacactgctgatgccttccagtagtctatgcgacctgagactctaccaccactctactgagaggttattaagatcaggaagtgagggcaaaggaaatttagaaacagaactcaggagctcagagagcccatggtgtattatatatgcaagggtagttttcagttttgcatgaagaatgtgtagtaagcatatagctcagtataccaagggcagcagggcaagaaaactgctttaaacagttaaaaaattatccaggcacggtggtgggtgcctgtggtcccagctactcgggaggctgaggcagggaggactgcttgaacctgggaggtcaaggctgcagtaagctatgatagcaccactgcactccagcctgggtgagagaccaagatcctgtctctaaaaactaagtaagtaaataaatcaataacaataacaaaggaaaagattaaaaggtcttcagagagagaaagaaagaacctgaagattctcctgggacttgagcccacacagagtcctcatgcggccctctcagcagcctatccaaattggctggcccagtccaacttacccactttggaataaattcaagaaaacaagagaagcagcattattgtgttgtttgtgtaactcatgtcaatcatataacagaatttcataggaaattctgaaagagcagaggactccaaacacaatcatgtgaaaaattcacacgggttatgtttttcttgactgttgtttaaaccaggagtcagccgggcgcagtggcttacgcctgtaatcccagcactctgagaggctgaggcacgaggattgcttgagtccaggagttcaagaccagcctgggcaacatagtgagacctccagctctaaatttttttttaagcttaaaaattaaaaaataaaaacaaaccaaaagttagcaaactacggtcatgtggctggctgcctgtttttgtaaataaagttttactggcatatggccatgcctgttcatttacatattgtccacgcctgctttctcactatgacagcagagttgagtagttgtgacagagtctgtgtggcctacaaagccaaaatatttacgatctggccctttccaggaagttttccagcccctggtttaaaagagtacaaattacctctggttttctctctggaaaggtttggcgatggttcttgctggttacccgtctgggtgttttgtgctgtttcccggagcacaggtggatctggagcagaggcaagcacacccccctccccattcacagagtgggccggttcacttgcttgccatttggttaccctttgctttttagtcctaggggcctggctgccagacggaggtttcttctctgcagggccttgaagggttttggtcttggtagcagtttgtttggtccttttcaatttgcttcttatctgagtgccgtttgaggcagccttttgtgtcttcctttctcctgacacttccttgattccatgttttttcaccctttggaaaaagctagcgcagagttctttaaagtcctcatcagactcatccatcatctgaccagttttaaggctttcaggctggtcttcagaggagcgagggtcaatcccaggacaggcagacagatgagaaagtgaacccaagtagaagcctagctgagcctcattcacactcagtttcattagggttcttctctacttctccattagatacttggagagtttgcacaattgaacaaaaagtactgttttcctctctataatgattgaagtatctttgttcaaattgggcctgtggttaaacatgtttaaagcttccctctgttaaagtccacaactgggccgggcgcggtggctcacacttgtaatcccagctcttttggaggacgaggcggggggtggatcacctgaggtcagaagttcgagaccagcctggccaatatggtgaaacctcgtttcaactgaaaatacaaaaaattggccaggcgtggtagcagatgcctgtaatcccagctactcgggaggcagaggcaagagaatcgcttgaacctgggaggcggagattgcagtgagccgagatcgtgccactgcactctaacctgggcaacaagagcaaaactctgtctcaaaaaataataataataaataaataaagttcacaactgaaagagtgttttgttgtccaatagatgcctctgagatcgaatacatatgaacctggtgctcagataattctccaagatctccatgatgatgaaacatatatggttcacttaattacacatctgtggaaaaccaaaagcatgtaagtgtaatcagacattgtcattttatgccagttcttccagggagggacaagggcatgtggggtgagggaaaagtcttcggagtaacaatactgtcaaatactcagtccagcctggttaacatggtctaaccgtcctatcagacatcacaacaaaaggacctagaaacctgtcaaagcatgttgttcttccacaggtattaaaatatgtgcatcttgggagagtgttttcttaactgaaatttagggagcaaaccccataaaaggcagtcaccacagaaacaggatgatccccaaatctaggaaaactatctcctacactgatctaagacccctggctgttaaagaggctctttctgtaaatactgcaacataagagacagaaagagacattatattctcatgaacactcaggagagaaaaggtcacttttacttatcttctcaacccagcaaggctctccaaacctggatgactggaatgtcgcctgtgtgcaaaggctgggcctcgtgagcatggttgtttactttggcacacagctaagtggggttcaaaaatcaaaactgaatgacccaatggcagaaagttattcctttcaaatacaataatgcaatctccactgtccaaggaatctaattaatcattttgttttccagagctgaaaatactcctacctagaatctactttgtatggctggcgcattctcttctgtgtcttccccttagagaagtgtcctctaatcctttatggaccgtctccatccccgttaatccctatcatcgcccactgttttcacaatggcatctgtcataggttatcatcatatgaaacaggtaatatctatcgaatgcttactgtgtgccaagcactgttccaattgctttccaagtcaaactcgtttaatccttacaagaagcctatatggtggaatctcttgtcatcctgtctttacggcaaggaaacacgcgcaagcagaatgaggaactggcctaaagccagttcaggaacagctttcacagtggcagggctgggatcaaacccaggaagtgtggttcgaaactatccgctcttgtgtttttattcatcggcttattatctgtcccccattaagctcaacacttcaggagggtagagatccatctattactttgcaacctctttggctgatctggtgcctgacttgaaataagtgctccacaactacttgttgaattcatgaattgcaaagagttcggtataatgggagtagagagaaaggtgtaggagaaaacgctgcggggagaggaaaggattggctcacaagggcctggaaggtcaggctaggcaaagtgaattttatcctgttggatgcggggagcggctggaacaaattccacctccacaactgtgttgatctccgcatctctgttgatatgaacctcacaacagtctatctcctcctataggtgcccagtcaagatttactgaatgacataacggatcctgcaagcctgcaggtttccagagggaaggggacttgtgcctccttgcttcgtacctaccgcagcccacggctcacagcaggcgagggatgaatgaatggatcggtaaggggcggaccctcccgcttcccccaacccggcgacctacggaaaggggctgaggggttccccgtctgggaaaagggctgccaaagactctaacggctctaaagtcagacggagaaccccgatccccggactggcccggacggagaccaccgtggggatccggatccgccaccctcctccctccaggcgggccccggcccctctccacccgagtgcggctcctgcctctccgtcggggctgcgggcctgccgaggccacggagccagcgagggagacgggcgagaaaggctcttctcccttaggaaagagagaacggcccgaaatgacaggacctccgcctcccgggtgccgactcccagccccacagcccggctcctcctacctccggcgccgccgcggcaccttct

SEQ ID NO: 959 - DNA, 3854 bp, Homo sapiens
agcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtaaggagggtcctctcccatcatcctggggatttctttttcttttctttttttttttttttctttttttgagacggaatcttgctctttcgcccaggcccgagtgcagtggcgctatctcggctcactgcaagctccgcctcccgggttcacgccattctcctgcctcagcctcccgagtagctgggactacaggcgcccgccaccgcgcccggctaattttttgtatttttagtagagacagggtttcaccgtgttagccaggatggtctcgatctcctgacctcgtgatccgcccgcctcggcctcccaaagtgctgggactacaggtgtgagccaccgtgcccggccgatttctttttcatctgggtaatgtttggtatctggatctctccctatttaagtctcagaagtggactggatggcttcagaagttgcttccagcctctatctgggaacctatcctgagttattaacaggtttttagaaaatccaactactgatacccagtgaggcaacagaggaccaaggttcttaccattcctttatgcaccttgtgtcaccagaagtaattgtaaggttcttaaatcccttctgtcagctcttcccccacccaacttagttttcctactagcagaattcttagcagatagggtcaccctgttgggtagcagttggactttggggaacttcatttcattggaagttctagcttattgtctttccagtgtttagcttatagtctttttttttttttttttttttttttttttttttttttgagatggagtcttgctgtgtttcccaagctggagtgcagtggtgccatttcagcccactgcaacctctgcaccccaggttcaagcgattctcaggtctcagcctcctgagtagctgggtttacaggtgcctgccaccacgcccagctaatttttgtactttttagtagagagggggtttcactatgttggccaggctagtctcgaactcctgacctcaagtgatcctcccgccttggcctctcaaagtgctgggattacaggcgtgagccaccacacctggcctagctttttgtctttgatttttttttttttttttgagactgggtctcactgtgttgctgaggctggagggcagtggcacgatctcagctcgctgcaacctccatgtccagctcaagtgttcctcacacctcagcctctcaagtagctgggactgcaggtacatgccaccatgcgtggctaatttttgtacttttgtagagacagggtttctccacattgcccaggctggtcttgaactcttcttgggcccaggcgatccgcccgtcttgacctcccaaagtgctgggattacaggagtgagccacacaatgcctgactagcttattgtctttggatcaggaagttacagttcaactggccagcgttgccattgcttgccactccccgccccgaagtcagaccccagtcaggacctaggcaagaagcaaacggcaggtacttcggaaaatagaacttgttagggaatgaaggtggggtggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttaggggaagccactcggctgatttgtagcatcctcattcctgtcattcttcacgttctcccctttacttcctttgagggtttcagtggtttctatgaaagttgacctctagatggttatcagcaattcccaaggtaaacgggtcattatacaacagtgagagatcaagcttccctcagtcctgatggatggaattaatggatggggcttgttcctaggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatctta

SEQ ID NO: 960 - DNA, 8175 bp, Homo sapiens
agcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtaaggagggtcctctcccatcatcctggggatttctttttcttttctttttttttttttttctttttttgagacggaatcttgctctttcgcccaggcccgagtgcagtggcgctatctcggctcactgcaagctccgcctcccgggttcacgccattctcctgcctcagcctcccgagtagctgggactacaggcgcccgccaccgcgcccggctaattttttgtatttttagtagagacagggtttcaccgtgttagccaggatggtctcgatctcctgacctcgtgatccgcccgcctcggcctcccaaagtgctgggactacaggtgtgagccaccgtgcccggccgatttctttttcatctgggtaatgtttggtatctggatctctccctatttaagtctcagaagtggactggatggcttcagaagttgcttccagcctctatctgggaacctatcctgagttattaacaggtttttagaaaatccaactactgatacccagtgaggcaacagaggaccaaggttcttaccattcctttatgcaccttgtgtcaccagaagtaattgtaaggttcttaaatcccttctgtcagctcttcccccacccaacttagttttcctactagcagaattcttagcagatagggtcaccctgttgggtagcagttggactttggggaacttcatttcattggaagttctagcttattgtctttccagtgtttagcttatagtctttttttttttttttttttttttttttttttttttttgagatggagtcttgctgtgtttcccaagctggagtgcagtggtgccatttcagcccactgcaacctctgcaccccaggttcaagcgattctcaggtctcagcctcctgagtagctgggtttacaggtgcctgccaccacgcccagctaatttttgtactttttagtagagagggggtttcactatgttggccaggctagtctcgaactcctgacctcaagtgatcctcccgccttggcctctcaaagtgctgggattacaggcgtgagccaccacacctggcctagctttttgtctttgatttttttttttttttttgagactgggtctcactgtgttgctgaggctggagggcagtggcacgatctcagctcgctgcaacctccatgtccagctcaagtgttcctcacacctcagcctctcaagtagctgggactgcaggtacatgccaccatgcgtggctaatttttgtacttttgtagagacagggtttctccacattgcccaggctggtcttgaactcttcttgggcccaggcgatccgcccgtcttgacctcccaaagtgctgggattacaggagtgagccacacaatgcctgactagcttattgtctttggatcaggaagttacagttcaactggccagcgttgccattgcttgccactccccgccccgaagtcagaccccagtcaggacctaggcaagaagcaaacggcaggtacttcggaaaatagaacttgttagggaatgaaggtggggtggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttaggggaagccactcggctgatttgtagcatcctcattcctgtcattcttcacgttctcccctttacttcctttgagggtttcagtggtttctatgaaagttgacctctagatggttatcagcaattcccaaggtaaacgggtcattatacaacagtgagagatcaagcttccctcagtcctgatggatggaattaatggatggggcttgttcctaggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtactttagatcctcaaatctatttccctttctctggtgtgatacttgtgtaactgctggccttgttctacacagtcctgtgatctctaagcctgaatgacagtgacattttggccaagcctggtgatgtgaatacaagatacagtgagcacgttagggaggagggttacaagacgacaaaaatcctcagtttcttaatatttgctacatccaatgaggtacttcgtgttttagtctgttcaggctgctaatataaaatgctagagactaggtagtttataaacaacaggagtttatttctcacagttctagaggctaggaagtctgagttcaaggtgccagcatggttgggttccagtgaggcccctcttccaggtcacagactgcctacttctcagtcctcatgtggcagaaggggaagacaggctcccgtggggctctttcatgaaggcactaatcccattccagtgagggcagcaccctcatgacctaatcacctcccaaaggccccatgtcctaacactattaccttgggagttagaatttcatatgaatttggaggaacataaacatttagcccctggcaaccacagtctactttttgtctctagaattgcttattctgaacattttatacaaatggaatcacacaggccgggcacagtggctcacgcctgtaatcccagcactttgggaggccaaggcaggcggatcacttaggctcaggagttcgagaccagcctgggcaacatggcgaaatcctgtctctacaaaaaatgcaaaaattagcggggcatggtgctgcacacctgtaatcccagctgcttgggggagctgaggcaggaggatcacttcaacctgggaggtcgaggctgcagtgaactgagatcgtgccactgcactctagcctatgtgacaaagtaagaccctgtctcaaaaataaataaataaataaattgaatcacacaatatgtggtcttttgtgtgtggcttctttcactgagcatgttttcaagttttatccatgctgtagcatcaatcagtgcttcattccttttctgtggctgaataataggcattgtacggatatattacatgttggttttctgttcatgttggttcatctgttcatagatttttgggttgtttctactttttggttattatgaagaatgctgctataaatgtgtgtttttgtgtagacatgttttcatttctcttgagtatatacctaggagtggaattaccatatgctaggtcatgtggtaattccatgtttaacttatgaggaactaccagactgttttccaaagcagctacaccattttacatccccaccaatactgtgtgaggattccgatttctccacattcttgctagcacttgttattgtcttatacccatcctattcggtgagaaattttgatttgaggttttgatttacatttccctagtgactaatggtgttgaacatcttttcatgtgcttattatccagttacatatcttgtgtggaaaaatatctgttcagatcctttggtcatttttaaattaggttatttgtctttattttttataagagtcctttatgtattctagatactagacccttatgtgtaatttgcaaatcttttctctcattttgtgggttgtctcactttcttgacagtgtcctttgacgcacacgtttttcattttgctgcagtctaatttatctatttttttctttctttatgctttggtgtcatatgtaaaatagcactgcctaatccaagggcacaaatatgtacagctatggtttcttcaaggagacatagatttagctcttactttcagctatttggtccattttaagtttattttttccccatacataaacaagtcaatttttatataggttttgaggtaggggtctgtcaatctgatcaggggtctgtcttaatctgatcaggctcttacaacaaattgccttagactaggtaatttataaacaacagaaatttgttgctcatagttcctggatactgggaagttcaagatcaaggtgccagcagatttggtgtctggcgagggcccattcctcataaatggtgcctgctatgagtccccacatggtagtctcttgggtttcttttataaggacactaatcccatttatgaggaccccaccctcataacctaatcacctcccagatgccccacctcccaagaccactgcactggggactgtcaatatatgtgtgtcaggggacaggggggataaacattcagaccatagcagggtccaacttcattctcttgtatgtggaaatccagtagtcctagaatcctttatgaaaaagactattcttttcccattgaattgtcttgtcaaaaagcaattgaccctgattgtataggctgattatttacatttgaatttaaatgaattaaaattaaaaaaaaatttaaaattaagttccttagtcacagtagtcacatttcaagtacccagtagccacatagtcacatgtggctagtggctgccatattgaacaacgtgcatgtgcctgtgcatgcacgtgtgcacacacacattttccacatcacaagggatccttctccagatcctgtgatttcccataggccgttccagctcatctccatccagactgtcaatccttctgtaattaggatacatggctaagccctgattccagtttctgaactcatatactgtcaaatttgtaatgaaagaaaacatcacagtctctgaacttaccatcttttgaagagaaggtggttgtcaattagtgtttactaagtgaggggtatttgttgaaatagctcaggcattggactacagcagtaaaatttgcaatgttgagatttcacctctcttccttcttcattagatacccaattctgatgggtttgcttttccctgttcttcatttcctaaacctttccctaaagggagaaaggaagaaggaggatggagaacttggttcctaaatttaatataaatcacagtcaccccaggagcctgctaactgtgcagattatcaggcccaaccccccgagattctgacccagcagctctgggggaagggtgaagagcctgcttgtttaacaagtgctccagatgagtctaatgcaagttgccagcggagggccaccctttgagaaacctctcagagtatttcataactcttgctgaagttatttcttccaagtgcagaaaatgaagcattttctttctaattatagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaa

SEQ ID NO: 961 - DNA, 18941 bp, Homo sapiens
tggagggagaaacaactttattttcatcagaaattagtaatgtttataaatttgtttatagtagtttgtaaattattatcagaaatagtaatgtctataaaccacttactttaagagacaatcaggaactatgatgagggcaataataaaaggagaaatcttacaaaaaattaacctggatgttgtgcttgctctaaggttaagtcacttagggaaacagattcagtattatccaatggcttaaccatccttccttctttctgtttgctttttggtggtggctgggttacaaagagcagtgtcttctgccctgaaggtagcagtattacggtgggtgcctagaggtcaattattggtttagaagagattcaggcccttaacttttacatgtgctttccaggaaaggagacactttctttctcagccctgtgtgaggactatgttagcccagaaagtgttcttggaccactgggtgcccattctcagtgctaggaacaggaagaccctggtttcctggtagaatttatggatcctacagctttctctccatcaaactttaagtcacagtaagataggactctggagtcacaggcacagccaggagaggtcagcgtccttatgctgactcctggtcctagacatgggtcttaagatccagtagtcagtaggtctgttgcaaagtcagggactggctagatctctccacagcagaagaaagctcatacatgctgacctgaggaacttaatctgacagtttaccgacacactcataacgcatctcttccttcctgtgatgagagtactgctttcatgtgtactgtctgatgacgggtgagggcagagttcttagtgaagcctctctcacagtgagaacacctgtaaggcttttcaccagtgtgggtttttcggtgggcactgaagtgggagctattgttgaagattttcccacacactgcacacttgtatgggctctccccagtgtggatgcgccggtgagcactgaactgggaactgttgttgaatctctttccacagacaatgcactggtaaggcttttccccggtatgggtcctctggtggacaatgaggctggaactctggttgaagcttttcccacattgcccacactgatagggcctctcccctgtgtgagttcgtaggtgggcagtgaggttggagcgctcactaaagcccttcccgcactcactgcacttgtgaggcttctcgcctgtgtggattctttgatgccgaacaagataagaacttcggctaaaggttttcccacattcaggacattgagatactttttccagtttgagcgctggcttgtggggagagtgcacactctgagagcagtttttcccacagaggatatgtgtacaggctttgtccctggcacaaaaactctggtgactcatcttctcctgggatggggttttctcctcactctcccctggagaatttctacattgccttcttgatgttggctcactctccaagcctttttgtagctcagagtgccaataaactcctctggactttctctgtaaagccttgtttatttctacttcctctgaatcatcccattttagattttcttttttaatctcgttcttgaactcaaaacctgaaaaaaaaaaaccccacagaaatacaatggactatagagaaggaaaacaatggaatgcaaagttataactatactacgtagaagaaatatctaattgaaattcttcatgtgattaagtctcctgctaattaatagctttttattttctcattgtaatatttttgagctccaaattattacaggaaaattatgccctaaactccaacttttctcctatcttttttcggatgttctgacacaatgacaaactgaggcaagacattaagcactatatcatctgccagtctgtttataggtgtaccctcaattcttgaatgttctaacttctagcagcagaataacaaaaggcaaccctgggcttggccagctcaaacaggaagaaagcaaggtgctaagtacccagccagcataggctcaggctgtgaaaggcaaggccatgctagagaaaaagggagaagatggacctggtctggaggcctaaccagcagtctgacaatgcatagtgaaactccatgggaaaagatgacatgaacttagttgaaagaggttggcaaatgcaaaatcagggctgtaaaatgcaaggggaataacctttaactccatgaaaaccaaaacttggatagggtcacacatcaagatgatgatgatgccaggatcagtgacagctcctactcaactgctaggctaatggcctctaaagtggactttgccatcctttgaccatcagagccaagggagtcttaccaagtctgtttgggaacagcactggcaggtctagtttcctgacttcctggccaggattcctgaagtccttttcatccctgtctgcaccatccacagtgccatcttctacctccgtgggttccccattctggtgattcagctctccagcctcaatatcacttccttcttggccaggaacagcatcgcttgccataggaggtgcagaggcccaggagcctgaaagagcattcatttcctcataaaagatacaaggctcaggcacacggcctctcctcactttgcggtaactcaactgtaggcttttgaacttggtgcgacactgttctggggtccgcagaaaaccctgctcccagagtccttccgccatggccctgtagatctggctgttctgctgacaggtctggagttttccataaaattgagaactactaagaatagccaggagcgtcttggtctcttcatagccccagggcacacctgttgctgggggacaaagaataggtcaattagatctgtcagttagatcatggaggactgtacatactgcagtgtgcagttttggcagcttaaaaagttacatcctaggctggatgcggtggctcacacctgtaatcccagcactttgggaggccaaggcgggcagatcatgaggtcaagagatcgagaccatcctggccaacatggtgaaaccccgtctctactaaaaatacaacaaaaaatagctgggtgtggtgccgtgtgcctgtagtcccagctactcaggaggctgaggaagaagaatcacttgaacccaggaggcagaggttgcagtgagctgagattgtgccactgcactccagcctgatgacagagagagaatgccatgctcatgggtaggaaaaatcaatatcgtgaaaatggccatactgctcaaggtaatttatagattcaatgccatccccatcaagctaccaatgactttcttcacagaattggaaaaaactactttaaagtttatatggaaccaaaaaagagcccgcattgccaagtcaatcctaagccaaaagaacaaagctggaggcatcacgctacctgacttcaaactatactacaaggctacagtaaccaaaacagcatggtactggtacaaaaacagagaaatagaccaatggaacagcacagagccctcagaaataatgccgcatatctacaaccatctgatctttgacaaacctgacaaaaacaagcaatggggaaaggattccctatttaataaatggtgctgggaaacctggctagccatatgtagaaagctgaaactggatcccttccttacaccttatacaaaaattaattcaagaaggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaaccaaagagcttctgcacagcaaaagaaactaccatcagagtgaacaggcaacctacagaatgggagaaaatttttgcaatctactcatctgacaaagggctaatatccagaatctacaatgaactctaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtcgcgattcctcagggatctagaaccagaaataccatttgacccagcaatcccattactaggtgtatacccaaaggattataaatcatgctgctataaagacacatgcacacgtatgtttattgcggcactattcacaacagcaaagacttggaaccaagccaaatgtccaacaatgatagactggattaagaaaatgtggcatgtatacaccatggaatactatgcaaccataaaaaatgatgagttcatgtcctttgtagggacatggatgaagctggaaaccatcattctcagcaaactattgcgaggacaaaaaaccaaataccacatgttgtcactcataggttgtaactgaacagtgagaacacatggacacaggtaggggaacatcacacacggaggcctgttgtggggtggggagagaggggagggatagcatttggagatatacctaatgttaaatgacgagttcatgggtgcagcacaccaacatggcacatgtatacatatgtaactaacctgcactttgtgcacatgtaccttaaagcttaaagtataaaaaaaaaaaaaaaaaaagttacatcctggtttctcaaaccgtgccacaactggctattgttatttctaggaagaaatctcactgtggctttttgtctaaaacatgaaaacttttagtataatacaaaagacattccctccactgataatgacttatagggttatttactaaagctgcctatttaatttctcgttaattatcctcaatcctactcattcctcctggagaggtggctggcaataagggtagtggcttgcctgccttgacagttgtgggacttcctgagggtggccacataagaggacacagtgaacaggtgatactcaaggaaagcaaagattcaggggacagaggagctggttgtaacgatatatctgcctgttccctccctgatacaggaatacctcctcagccagcccatctctatctgtttatatctcctgtcatccttgtagatacaggaaactaaatgacagcagttaacacaccaaggtaagaataagtagtaaacatctgagaagagcagttcaggatggctggctactaaataaccctcaccacacacacctgctgcccatctgggccagttcatgaggaccgatttgactagagctgtcccagcaagtgcattccaacatctggtcatgatgctctgaagcgcaccagcctcttcttgtcaccccctcttctccacactgagccaccatcacctcatgcctggatcactgccatagcctatctggtcttcttgcttccactctggaccttctacggtctactttcaacccaacagccagagggagtcccctcctttgttattcaatttaactaacactgagtgcctacaatgccagtttctgagaaatataaatattacatgaaccctgccttcaaggaggtcacagtcctatagaagtctctccagcaaaaagagacacaaataaatgtttacgtagagttaagtgccaaataaagtgacatactcaaagtggtccttttaaaactattactcctctgcccagaaccgcacaaggctcccccatttcactcagaagaaaaaagtccttcatgtagggcctcatgatcccatattagtacttctcaaattatctatgaaggacaggagtcttgtgcttatttcttttgtaaaatacaataaaaatgcaaccgaatagtgcagcagtgtcaaattgttataaaagtttctaattgctccctctcagtctcagctagcagcactcatttgatctggctttctgagctcgttttctcattactcatgggtgtactctgtgccagtgaactggcatgcccacctcgctccagcccaagtcattgcgtctgtcttacactcttcctccatgtaggatatggctgcatagctcatccctcctccttcagcaagtcttttcaaatgtcattttctcagtgagggcgaccctgaggacccaaactgaaaactgcaaaccaacctctgccctagcactcccatcacgctgctctgctgctgcttctctcccattgcgcttatcgccctctaacatcttctgccgcttactgattatgctatggtctgtctcttcccacagggcaggaatctttatctgtttgttcactgttgtatccctaacgacctagaactaggtctgagatactgtaggcactaaattaatatttgtggaaagaatgacttgtcctctcacattctgtctcaactcttacctctaattttaaaggatcctcaatggttgacaagaaaccaaaagtgtgtggggaatacaagccctcattcaataagcctaatgttgtagcagttaaaattacaggtaccattacatgaaatattcagaatagctcaatccacagagacagaatgaagactggtgtctgcaaagggcttgcaggggaaggacggggagaaactgctggatggttgtgggaccttactttggagagatggaaaggttctggaactggacgtggtggtaattatacaacactctgaaagtgctagaggccaaagaattgttcactttacagtggttaattttatgtcatgtgaatttcacctaataagttaaaaatcacaagtacaaaaatatttatatctcaccttattgtattatccatatatacttagtaatacaaatctcaatacagagctcaaaaagacactatactctcctgcaactggacagagatgaggtgcagaagcctgaagcagcagcaagaaatggcacatgatgaagccaggaaactgggagttcctggcaaaggaggggagggatggcaggggcagagcagggaaaaaccacacaccactggggagggcaacattgtagagtgaggcggggcactgtcacagggcctgtgttcacagccttgtgtagtccctcccaccctgggcttagccaggagtaccctgcatgtgaagcagcagaggagaaatctaggcccagtgagctgcagtgtctgtctctgaatctgcatggtcagggaggctgctctgaggaggaggcatttggcccagatgggacagaactgatttgagaaaggcaagagagcggtctgcttggcagaaccttccccaagtgtcctgagatgctgggaaagggcctggttcctcccggaaggcctgggcatagtagactgtcctggttgggtggttttatttgttaatctcctctgccactggggaaactcgggagcgactactgctacctgtgtgcatgagcgcacattcagcatgaacacatctgtgctcctggtggccacctgtctggctccggctctggactacttgttctgactctgtctcactaacattttgcttctccaccgcctcacccttcacctcccatgttcttgactgccggtcacacatgctgcccctttcttttgatctctgcctgtgtctctctggcctgctctggttccccatttacttcctcctttccctccacccaacagtctccccactccctctgtctccctccctctcaagtcctttcagcctctctgaacaactgaacacatccaccttgacctggagggaagatggatccttacccagcgagacgtgactgtccttcctctgggtggcacccctgtagagggccctttgtgcagggcctgggcacatccattcttgctgacagagggatacagctctgttgtcacgcatggctggtccctgtaacaacactggagctgctgctaccgataaaatagcaccactctagcctggggtgggggcagagacaggatcacagttgtcagatcaggggcaaggcaaaggcaggggaggtcagctcccagtgggacaggttctgagccatgtgatgatgtcagagtggacagaatcaaaataacccgagaagccccatggaccacacagaatctttctcatgtctctggaaaggaggagggttttggggtgagagtgggtactcaagagacagaaggcatcaaccacagctcacctgggacccagctgtccagaccacagcacctgtctcctggtcgtggagacctgtgttttgaggcaggttcctgggagcctgaggagcaagccaggctgggggaaaaaacagccgctattagagggcggcttccacacaacagcacagagcagaagctctcaaagtgggctcctgggccagccgcatcagcagcccctggcaacccatcagaaatacaaattctggggccccacctcagatcttctgaatcggaaattctggaggtggggcctaggactctgttttatcactctcccacctccgaatgagtctgaggcaaactcaagtttgagaaccactgccagcgctcacggcctctgtgagttgagaagttcctttcatgagattcctcttggcataagagctttaatttttttttcattttaaagaaaaatatacatgtcagggaaaaaaagagaatcgtagtgggcaaacaaaaatctctccatagccctgccacccaaagataaccagagtactctttaaaataccacagtaacagaaacccttcatatttttcacaccaagataatacattttttctcaagtctccaacttcaagaattgtacaaatatgactgtgacatcgcttaaaaatacaggaaaattaaaaaaattgtacaaataaaatgaatcatgtctatgacttattaatggaacttcagtggcaactcagaggtatgtgacccttcgggaggtgacaacactccagatctgtgagtggcccatgggcctgggaagagcgggagcctagcctggaaggcagcaagtcctgcttctctttacttacagccccctgctgtcccaaagccttggaaatcacacacagagaacacaggtgttcccaaggattaaaaggaaataaatgctaagtggcaaagtttataaagatgttgacaagagtattaactttgcttaaaaaaaaactaaaatcagccgggcgcggtggctcacgcctgtaatcccagcactttgggaggccgaggcaggcagatcacctgaggtcaggagttcgagaccagcctgcccaacatggcgaaaccctgtctctactaaaaatacaaaaaattagccgggcgtggtggcaggcgcctgtaatcccagctactcaggacgctgaggcaagagaatcacttgaacccaggaggcagaggttgcagtgagccaacatcatgccgctacactccagcctgggcgacaagagtgaaactccatctcaaaaaaaaaaaaaaaaaacaaaatactaaaatctcttagacaattttccagtttatcaacacaggtttgccaacttaaacatcatcaagacacactgtttttcaggctggatgtggtggcacatgcctgtattcccagcactttgggaggctgaggcaggaggactgcttgaacctagcagtttgaggcagcagtgaactatgatgccaccactgcactccagcctgggcaacagagcaagaccctgtctcttaaaaaaacttacctagcaacctgtaatggcagcttccaattaaacagaaaaggcagcaagtatctagccaaattactttatggaaaaagacttataaaaatatagacccttggaatatccatgcaatggaatattcagccatcaaaaggaacaaagtactgatacatgctcaaaacatgaaaagtgaaagaaggcagacacaaaacgtcacataatacatgtgattcaacttatatgaaatgtccacaacaggtaaatccatggaaacagaatggggagcaactgtttaatgggtacagggtttccttttcgggaggataaaaatgttttgaaactagacagaggtgatggctgcataacactgtgaatgtactaagcataactgaattgttcattgaaatggttaattttatgttatgtgaccttcacctcaattaaaacaattttttttttttttttttggtagagacaggatcttgttatgttgcccaggttggtctcgactcctaggctcaagctatcctcccgcttcagcctcccaaagtgctgaggttacaggcataagccattgtacccagccaagataatttttttagtttaaaaagttttctaaggccaggcgtggtggctcatgcctgtaatcccagcactttgggaggccgaggcaggtggatcacgaggtcaggagatcgagaccatcctggctaacacgatgaaacgccgtctctactaaaaattcaaaaaattagccgggcatggtggcgggtgctttagtcccagctacttgggaggctgaggcaggagaatggcgtgaacctgggaggcagagcttgcagtaagccaagatcgcattactgcactccagcctgggcgacagagcaagactccgtctcaaaaaacaaagaaacaaaaaaagttttctaaaaaaattaagacaagtaaaaacaaaaaatagagctctggaagaaaagcaaaaataataaaaatgtattctggaaaagattaagttggatggggaaggggatttaatgtcttcaagtatatgaaaaactgctgtgcagaaggtgaaggtaaccatgttcacctttaatgacacctgattctttagtaacagaattgtaataaaaaagaattatgctaacacataaagaatctctgttcctactttaagtgctattaccctcaactgaaatttgtaatcttgcttttggatatggagagagatatatatatatttctatatatatatttctatatttatatatatatttatatttatatatatatatatatataaatttatatattttatatatatatatattttttgttttctttgagacagcccaggctggaatacagtggtgcgatcttggctgactgcaaccttcacctcctgggttcaagcagttctcctgactcagcctcctgagtagctgggattaccatgcccagctaattttttgtatttttagtagaaacggggtttcacgatgttagcaagactggtctcgaactcctgacctcaggtgatccgcctgtctggtcttccaaggtgctgggattacaggcgtgagccaacacgccctgccggtttttggatgtatttcaaaggcatttagtctggaacccttgggtggactcagttcagacctttgtttccagtaaatgattgttcctcacctgcctcaggtgaggacagaggcttctgcttaccttctgactgttcccctggtctttggtgtgagctctgtgatcccttaaaagtcggttcctctggctgaacctcctgtttccattgggatctcagtgattctctggttgctcccaaaggggccatctccttcatgagtactttcaagtccttctcagaatctagaacctgagaacagaccccattatctatcactacaaattcctgcctaagctggactttacaactcctaagagtggcattaaaaaatgtgtaacataaggaagcagaagagaaaaatctaggagccactgtattgctgctgtaataaaataaaaattaatagaattaggtatttgaggggcagtagcttacgcctgtaatcccagcactttgggaggccgaggcaggtggatcacgtgaggtcaggagttcaaggccagcctggcaacaaggtgaaagaaaccccgtctctactaaaaatacaaacattagctgggtgtagtggtgtgaatctgtaaccccagctatttgggaggctgaggcaggagaatcacttgaacccaggaggcggaggttgcagtgatccaagatcacgccactgcactccagcgtggacaacacagcaagactctgtctcaaaaacaaaaaaaaactctttgaagtggttaagattatttatatgacagcacctagcatagagcctgacacaccagaactgttaaaaactgaaatatatttgtcagaagagagaatgtcagctttcactttagcaaacccccatgacttcagcactaggccatttcctctgccccccaaatccagtatcagttctgtcttcaaaagagacctcgcattggtcctctctcttcacctcatggctccatcagggtccaggacactatctgctgtctgcatcctctctactgctggaccctccaatccattctctctacatggaacccagtgtgatctttttaaaatctagagtcctgtccctccgtagtaacagcactcttcagtggcttcccactgcacacagaataaaatccagactcctctttgcagcctaaaaggcccagcatcattctgcccggcctcctccctttctctcacagcactcttccccagtctctgagctccagccacaagccctcccttcttcctctcaaacccgcccagtcttttcccaccttaggctcttggtatgtgctgtgccctctgtctggagtactctcctcccagctcttgggacaactggttccttctcctccttcagtgtcacctcagagaagtcctgcctcacagcctatctcccaacactccagttatcacatcactctgctcatttccttccaagcactcatctgaaacgatctttatggtttacttttgatttatgattgtctgtttcccccatggaccgcgggctccagcaggccaggggccgtgcctgtcctgttcactgtaaaatcctcaatatcaacggtcactgaaaatcaacttttgtctttcagagccatcttcattctttaagtcccatgcttataacaaacacccttaaagggaatgaagagaggtactgagaggcaagtggggtcctgagaaattatatcaacctctattactactacccacctccacttcttgctctctccttcactttcatgataggtaataaggtttggctgtgtccccacccaaatctcatcttcagttgtagttcccataatccccacgtgtcatgggaaggacccggtggacgtaattgaatcatgggggcagtttcctccatgctactctagtgatagtaagttctcatggcttcccccttcactcagttctcattcttctctttcctgctgccatgtgaaggaggacatgtttgcttccccttccgccatgactgtaagtttcctgaggcctccacagccatgcagaactgtgagtcaattaaacctcttctctttataaattatccagtctcgggtatgtccttatagcagtgtgagaacggactaataaattaggtttcaaataggtgtttaacctatacactcctgcactgttttcttttatattaagagtgtgggccgggcacaatggttcacacctgtattcccaacactttgggaggctgaggtgggtggactgcctgagctcagaaggtcaagaccagcctaagcaacatggcaaaacctcacctgtaataaaaaacaaaaattagttgggcatggtggtgtgcacctgtagtcccagctacttggggggctgaggcaagaggatcgcttgaacccaggaggctgagactgcagtgagccgcattcatgccactgcactccaacctaagtgacagaccaagaccctttcaaaaaataaataaataaaataaacataagtgtgattccgacatggttaaggataagaagaggagagaccatcaaacagagtgatggaaggggaactgggctaggatgactcttggcatactgggattcccactctatttataatagttcagttctccaagttctaccttcatacaagtgctactgcacctctccattcaatcttacttatgaataagagtcccaatcccacagatttcagactaatttcctgaacttcttccctgatgcatcaccatcaagctgctcttcccctctctaaattaagtcaaaagtactaactcttcaatcctaccaaatttcatctatatcccccttcacccattcctcttcccacagcccgtgcacatccctacctcctcactgggaaacacaagtatatctgctgcctagggccttcccattccagccatgcagactctggcacccagcaagctgcttcctgctctgatcacagacccactcaggctgaccaacgttcctctgacctgtgccctccattactctaggcctctcccagacttacccaatttcagttgccttcctcctaccaactcttccacaaccgaagctggtatgttacttttcctcttcctgtgcctttcccacctccctgctccaagaaaatataagctggttacaccaatcagatctcagacctagtcctgaccgtaagaggatattttatgaatccatcagtgtcccaaactgaacacttaatcccggcatcaagaactagagcaaggcctggctctaatataattttgttgagtgtacaacacatgtcactctgccctcaaagaagctcctagcatgaaactagattttcattcactagcatctctagttttcctccatcccctgagtgaaggagagttgtcctttccctggccttgttttcgagaatttttctgagtgtttttaccaccttaattagggacttcaaatattattaaatatatgaatgtctagcagctgtatccacagatgagaaattcttcccgtattataagggcataggaccaatccaagacagccaagaccttctgtgggcagcagagggctactgtgtgtttctcaaccaagcacctctccagtaactggattccccgacaacttcataaccaaaaccacaaagttccgacttccttttctcacctgttgtccaggagctctctgtacatcctcaaccagagccacagcttcctcgccgttttctggatgctgctccctcacccaggtctggatctcctctggcaagatagtcagaaactgctccaaaaccagcagctccaggatttcctcttttgagtgggtcttcggcctcagccactgacaacagagttcccagagtttgctaaaagcttcatgtgggccagttacctcctggtagcaaaactgcctgaagcgctgacgggaggcctcggagtcagggctgttaccctggagggctgatttctggccctgtgtgggatccttgtttgaggatgggtgtgcctcggtactcttcactgcagccatcatttgcttcaacgaactggcttactctggttgccacttctaccctggagatcagagtccatctttcccacatcactgggaagccatgttctcctgcaaggaatgtctttctgtaatccgtgggacatgagagtgtcagacatgtgtagagactcacagcggaaaaaaagggctcaactttgaaggatgtctgaagaggatggaaaaagacaatataaacctatcaaacattccttcactctggttcttgtgatttacttcctatccctttcctttactccctccacaaatctacaccaaggatccaaaacactagaaatagatctagaccatcctggctaactgcctttgcaaaaaccattaacagtgagaagattatgacactaaaagagataggatctaaccaactccatcttgcttttaacctccaaactgccgttggtcattcctgggtgtgggccaagctagctttgggagaaatttagtttatagtttgaatgataataacccttcccaaaactaaactgcctttgtaaaactaattaaagacaactaggttaggaggatgagaggggcctgaattctgctaagatgcaggcataatgaaatgattatccagaggtcacaagatttgcaacttccccaattaaataacatcacgattgtagaacctaagattggccttttgagatgccttttcaggcctctgctttctgacaaccagatggctccacctagaccagggactcctctgtggctcccacccaaaatcgcactcagcacacaaaaaccgttttccacagccctatgaatgcatccccaaccagtcagcattccctgttccctacccaactgcgtgccaaagccctagcctctgaatttccggggaggctgacttgagtaataaaactttagtctcccatttagccggttctgtgcgtattaaactctttctctattgcagttcccctgtcttgacaaactggctttatctaggcagtgggcaagatgaacccactgggcagttacagtaccaaaaaatatagtcttctcccagccaagattctgtgtctgctgacgaattactcaaactgttcctgacgatatagttcacctgttccttcccttcttccctcacacacctaggtctttttcctgtccttccctatcctcaagaagcctgaattcatgttcccaattgctaccctctcctcgggggagaactggtgtgtgtgtgcttcttgattaacttcttcattactattactccacacacacacaacgtggataagtgactgttcgggtttgctgtatgtttttattttccagcattcctttcccacttctagtagcagcatcttcttcctttgtgaaaaagtccccctcgaccaggcgtggtggctcacgcttgcaatcccagcactttgagaggccaaggcgggcggatcacgtggtcaggagatctagaccatcctggctaacaagatgaaactccgtctctactaaaaatacaaaaaaattagctgggcatggtggcacgcacctgtagtcgcagctactcgggaggctgaggcaggagaatcgcttgaacccgggaggcggaggttgcagtgagctgtgatcacgccattgcactccagcctgggcaacaagagcgagactgtctcaaaaaaagaaaaagtccctctcattggttctggtggggatattaattacaatacccacttccccagaagtgggcatatgacacacagctaggcctatcaaaattcttttctcagattttacatgagaggtagggaaagctcttcattttctaggaattggtaaattgggcaaatgtaagatcagagttgtctccaactatgtcccactctctactccactcttccatcacaggagtgagcctgtttacaagaggacaatatactcaagtcttgacaacatgtttggatctccaaggccagtttatgtaaggcaatatttttttaagagttaattttaaaaatagttttatataatttaaaattaataaataacttttaaaaataattttatttgtttttttatctttagagatggagtctcactctgttgcccaggctggtctcaaactcctgaactcaagcaatcctcccacctcaacctcccaaagtgttaggattacaagtataagccaccatgcccgaccttaaaaataattttaaatagaagctaacttttgtattttttgtagaggtggagtttcactatgttgcccaggctggtctcaaactcctgtgctcaagtgatcctcccaccttggcctcccaaagtgctgggattacaggtgtgagccactgcacccgcgaaggcagtcttttttaatgagtttgtgttggtttttatctacttaaaacacagattaaagcagatcgtaatttacattttctccaggggctgatacaccctcaccatgtggtattaaaatggatccagcatgcacaacaagatgaatatactcaggactactgagctgtacacttaaaaatggttatgatggtaaatgttttttaaaaattaaagaaatttttttatattttaaaaatggatttgggttcccttttctcaaggaacttgaactgccttcacttaaattctctttacatttcagtgcttctagagatagagaaatcaagggcattattattgttagcactgctttctagccaaaaagaaactgagagcgatgaagtatcttgcctaaagcatcacacagcacagctcctaggcagcaaggccaggactagaaccagcaccccttgccttcattatgttcatcctgtgccttacctggctgaagaagaatttaataaaagctcttctaacttcatgcagaaggcggaacctgcacccttcttgaccccttttgaccccttacctcccactcatcgttaaattttaaaatgctgttctctgaaaattttacttcactctagcgatggcccaaacactcggaaaaaaatgtagcatgaggatggggagccaggttgataggtttttcacttagttaactatttattgagtactcagaacgcactcggtgccagggctaggcactgtggatgagtagggagtgggcgagacagggacgagatgagcagggtcaaggccagggggtcccggggcgccggcgctcaggctcggggtgatccgcacggtgggagcggggcacggtgatcgcggcgcgtctggggacgcccggcctgagggaggctgcctgtcccaaggagacgcccatcggggccggacccgaacgcctcggagaagactcccagcggggaggggctcctcggccgtcgcagggcccagcggctaatcccgccggccgcaaggaagcggagaactcaccggacaccagcactcgcgactccacaaactccctcagcctccgggccggaagtcagcggcgcgattcgctccgcccattac

SEQ ID NO: 962 - DNA, 7381 bp, Homo sapiens
taactttagcaagagccttcattttaatgaaaattgaatttaaacaaaagttgtgtatcttcttctggctcacagttgtacagtaactgagttcaaatcctgggttcattcactagtttagtgacacggattttgcatccctacttataaaatggaaatgatactgcctaaatcacggttgtgctgagaattaagtattacatgggaatgtgtgtaaagtgcttagcacattgcctgggacatatacagtaactgcttcccaccatacagatactgaaaagcccaatcactaataacaatttgttatatttactttacgtggtgttttttatgtgagttcgcttatgagtaatgagatgcaaattcgacttgaaagttttcccacacacggtacatttaaaaggttccgctagcatgtggctcttctggtggcatgcaagttctgagtccaaagcaaaactttcctcgcatgttttgcacttatggggcctttcctctgtatgaatgttctgatgggaaataagctcagagaaacaaggaaaggtcatgtcacagtcaggacactgtaagggcttgaattttgagaatgagaagaaattgtccccatcatcgctgcagcgttcagagtcctcgtcgtggctcttctcggaaagggcaggatataaggactgcctgaagctcttcatgcacttagtgtgctggtactgggggcctgatacgaatgtttcctcaggcaaagcaagatttggtttctcattaaaatgtttatcacagttagtagattcgtaggtgttttcagcactgtggcttttctgatgctgtgccaatcctgggagccacataaaacctctaccacatatgctacatgtatagggcttctcctttacgtggctattcatgtgtcgggatagatgagagtgctggcgaaagctggcactgcacttggcacacttataaggtttctcaccagtatggattctcctgtgtgtcctcaggttggctctatgattgaagatctttccacagtcaccacatttatgttttttctctcctgaatgaattttctgatgcaaaactaggtatgaatgatcgctgaagttttggtcacactcaggacatttgtacacatttttggctccttcccagggagaatcaagaatttcagaaagtgtgttggttcctaaatattcagagagttctactaatggggtgtggttttcaatggtaactaaaaggctgatgacccttctcttgtaagtgggagttccacttaatattttcgcttcagggtttccaactccatcctcagaggatttttctgggtaagggacaaggggtgcagcaatggggtacttttctaaggcaagctcgtcaagttccatagactctaggcttaactgctgattaatctcaggcttgccttcctctcctgttgataaaaacaaaagaaagcaaaacatagacaatatcttcaagggatactggggaaaaagtaagctaaggtagttacaaacaggaccaggaaaccttagaagggttattctataacccagacactaaccacacaaaatcaggaccaagcagactctcctggcctcccagaagatccagttttgggtgaatatccaaaggtaaggagagaatagctataactaagtcagagtccagtgggataggtactaaggacaatctcagtagcagctatctagaggtgaacttttccatctaatctatttaggcctcaagagcctttcatttttgaagctatctcaagtgacagcagaacaattaacaattggaaaaaagattaggattcatatttatcaacaaagagaggggttgggcagtgtctcacgtctgtaatctcagcactttgggaagctgaggtgggagcatcacttgaggctaggagtttgagaccagtctgggcaacacagtgagaccccatctgtacaaaaaataatttttaaaaattagccaggcatggtggcacatgcctatagtcctagatactcaggaggctgagacaggaggatcacttgagctcaggagtttgagatgtgccattgcactccagcctaggtgacagagccagaacttgtttcttaaaaaaaaaaaaaaaagatgacagcaagaatgagtgggaaagaaaataatttttaaaaagaggctgggcacggtggctcacacctgtgatcccagcactttgggaggccgaggcgggtggatcacgagatcaggagatcaagaccatcctggctaacacggtgaaaccccatctctactaaaaaaaaatacagaaaattagctgggcgtggtggcctgcgcctgtcgtcccagctactcgggaggctgaggcaggagaatggcgtgaacccaggaggcggagcttgcagtgagccgagatcgcgccactgcactccagcctgggcgacagagcaagactctgtctcaaaaaaaaataataataataattaaaaaagaaaaaagaaaaaaaagcaatcaagtgagcatttttcttccataacaaagaaacacacgggttatcagaaatagttttattatcaccaggagaactctccaaaatctctttactcctcactgaggaaagatcaaggtagaaggctgtgtgtactgcatgaaaataacagccaatctacttacaagaatggctgacaaaactaacattcctgtgtaatattttccaagtattcttcagttataaagcaaatatatcaatacaaaaggaacttttctttccagagaaacaaagttctacagttttcccaactcactgactagaaagggctgcagtatagttcatgggaatccaaacagtaccaagtggttttgctgatttgaggggactgagttcagagatcagggatgccaaggcagctagaatttgaaagcaaaacagcaaagaggcagctgttcagaaagagagctcaggtcatctacatggggtccccttaagactttcctgaggctaggtacagtggctcaaacctgtaatcccagcacattgggaggctgaggtgggagaattgcttgagccacggagctcgagaccagcctgggcaacatggcaaagccccatccctacaaaaaaaaaacaacaaaaaaagacaagcatggtagtgcatgcctgtagtcccagctacttgggaggctgaggtgggaggactgcttgagcctgggaggtcagggctgcagtgagccgtgattgtgccactgcactccagcctgggtgacagatcaagatactgtatcaaaaaaaaaataaccccacaactttggctgagtagtaatctacaagtgcatgaagaaactacccaatgccgtggaaagaaccacctaaaaggaataacagagcaataaccagttcatgttgcctccagccaaagtggaaagacataagacattgagcagcaacgtccacagaaaaaaactgccttagcagtaactcaaataagtcctagcagaaaggttgatctgaacctatcctaacaaagcaaaaaaaaaaagcacaccttgaaacagtcaaactgactccaagtaacttaactgcctcccacaacaaagtccaaaatatttttaaaaatacaacgaaatcccgggtccaacaacataaaattcttaatctaacatccgaccaaaatttacccaggaagtaaagaaaatatagaaaatataacccataactagaagacaaatcaatcaatagaaacagacccagaaatgacatcaatgttaaaactagcaagaaaaaaaagtttaaataaccattataaatatactccatacatttacgcagacagaagacaacatgaacatgatgaagagagaagtggaagaaacaaaatatgagttattcagaataactagttactctagttatttttttctgactaggattgagtatctcaactattccaaactatttagaataactacttagaatagatagtttagatactcaatcctagtcagaaataaaatctagtcaggcacaggagtccatctgtgtatggttccccttaggtgagtaaggcatagcaccccttaagagtaaatcaatctccagtctttagcaaatgatagtgatcgatactaatgggatttcccaagtaaaattgtaaactgcaacaaatgtttgtgaaagattaccaaatactgccatctcttgtactaaaccacaggcactgtactagactgaatttttgtctttaagagatcatctcggccgggctcagtggctcatgcctgtaatcccagcactttgggaggccgaggcgggtgatcacaaggtcaggagattgagaccatcctggctaacacggtgaaaccctgtctctactaaaaatacaaaaaattagctgggcatggtggcaggcggctgtagtcccagctactcgggaggctgaggcaggagaatggcgtgaacctgggaggcgcggtttgcagtgagcagagatcgtgccactgcactccagcctgggcaacagagcgagagtctgtctcaaaaaaaaaaaatcatctcatattttaaaactttttctctcacacaattatcacctccacataaattactgagggacaggtcccactccaccataccaacatctggataaagcatgaagttctcctcctagaattgacaaaagttccagatgcaggaaaaacaattgccttacccatcaaagccgcatcctccaaagactcttttgtaccatctttgctgagggacctctgggcagggtgcagagtcacgcactcctcttgagaaaaatacacagccagatcctcaaagagtattggtccctgaaacacaagagcctgtgtcagcacaagagggtggagggtcagcccctcacttaacctaggaaggatgaaaagagctagaaacatcagatgcacgggataaaaggctcggtgtaaaaggttcttgagcgcagaagtagggcaaatgggttctaaggggtggggtgagggttgggaagaagagagtaaacatggacatacatttttaggcagtggtacaaggacggtggactgtgagaattattgtctatcttgaaagagaaaagatgagggaatggctcttagggaggcaaccattaagtgaggatgctctaagaaaaggagaggtttggggccgggtgtggtggctcatgcctgtaatcccaacactttgggagtctgagggggatgcagatgacttgaggtcaggtgttcgagaccagcctggccaatatggtgaaaccctgtctctactaaaattacaaaaattaaggctgggcacagtggctcacgcctgtaaccccagcactttggaaggtggaggcgagtggatcacctgaggtcaggagttcaagaccagcctgaccaacatggtgaaattctgtctgcactaaatacaaaaaattagccaggtgtggtggcgcatgcctataatcccagctacttgggaggctgaggcaggagaatcatttgaacctaggagaaagaggttgcagtaagccgagattgcaccattgcactccagcctgggcaacaagagtaaaactccgtctcaagcagagcttgcagtgagctgagatcgtgccactgcactccagcctgggcaacagagcgacactccatctcaaaaacaaaaacaaaaacaaaacaacaacaaaaaaaactctgtctcaaaaaataaattaaaataaaatgaaattagccagatgtggtggcatgcgcctgtagtcccagctacttgggaggctgggccaggagaatcgtttgaatccaggaggcagagattgcagtgagccgagatcgcgccattgcactccagcctaggcgtcgcagcgagactgtctcaaaaaaaaaaaaaaaaagaaaagaaaaggagaaagttgggcagcccaggaagaatcataaagagataaaggttacaggattctcccaacatccttccctttgctatttcctctcgtccccatgacactcattgctaagctcactccagcacttcatccaggcctaccccaccttctctaacggtgtgataaattaatcacttgggatttattattactcaacgagtgtggagtctagaaatgtgcttaatttaaaaattcattcaaattggagaagtaccaaatctgtaattttgggaaccattccagaaagtcacttttaatcctagcactttggggagccgaggtgggaggatagctgaaggccaggagttccttggcaaagcagcaagactccatctccataaagaagttttaggccgggcgcagtggctcacacctgtaattccagcactttgggagaccgaggcgggcggatcacaaggtcaggagattgagaccatcctggctaacacggtgaaaccccgtctctactaaaaatacaaaaaattagcagggcgtggcggcaggcgcctgtagtcccatctactcgggaggctgaggcaggagaatggcatgaacccgggaggcggagcttgcagtgagccgagatcgcgccactgcactccagcctgggcgacagagcgagactctgtatcaaaaaaaaaaaaaaaagaacttttaaaagtagccagacactgtggtatgcgcgcctctcagatactcgagaggctgaggcgtaaggattccctgagttccagacggagctatgatatcagcactgcactccagccagacaagcaacactccagcgacaaggccagaccctatctccaaacaaaacaaaacaaacagataagacattgagaaactctctcagagattcctccacaggtccctgctcccagttggtagttctgaaagaaggaagttggtaaaccattatgtgtgtggtcttggaacgaagaacacttggtcaaagggctatttggggctcaggagcactcctaccacaacaggcatgcccaactctcctccaaaggagggggtcaggcagagaccgaaagcagcaataaacttggacgaaaaaggtacctcgactcacctgggcctcgggcgtcgggggcatggacgccatttggcgggtggggaatgccttcttcaagacgccacagggacttcgtgacaaagctgcggggggagagaacagttcttaaagggaccaattccgctgccaagttcctccactacccctagcctccctcgattccctccgaacccccccttaaaaacctacgccgactgctcctcctcttggcccggcctcgaaaggggcccacttaccgctccgcggttaataacaggcctcgcgctccctgacaggagctgcagaaagcgacgcccgaccgagacgcgacgaagaacgccacggccactgcaaaactcccacgctctcatgctcctttacgcaggag

SEQ ID NO: 963 - DNA, 516280 bp, Homo sapiens
tgcctctcaagcagcctctggtcatctatctgcctttgagccatcaagatgccgatgtcttctcttccagcagctattttgtctcacatgacagctattaacaatgtgcctcctcctccacttcacagtataccaagtgagtgggaaatactttgatgctcttattcacctaccattgttttcagcggttcttaccccagctatgaaaattgggggtatttcagggttgatagggacattgggaatcttattgacagtgctgaagaatggaaagaacatagatgtgtaaatcctgcttggtctacttgaagtcatttcagtactctaggtcttaagtattttttctctgtaaaatgaggatctttacgaactcttagagcttcagatacattgaaatatttctaaagatgaaagaaaacaaagatttagagaggccacatgttccaccagctatcaggttcctttttctagcagatcttctactccctaccaagagttggtcctactacgcttaatgggataattaatacttaatattctctaggagaattctcatttcaatttgacaaggaaaaaaagataattcctactattctgactgtgaaatttattcctatttaacttttttattttctagtcttacttataagaattaagtatagaactagatatttcaaagtttatataattgacagtattttctcattttatgtaattagtctaaacctataacgttttcttaagattgtaaacacttctcatggccatcgaatttataagatctattatttgaacaccatcattctgactagcaatatgtatgagttccagtgttagttaagatttttaaaaaatatctggataacaaaggtaatacttgtgatccttttcaacttcaataaagcattaactcttattttattattcattgggcagatttatagtattgatttgaagaagctaagccatccatccttttcccttcctgtgaaagttaatttctccaaatacattttaaaaaattaatgctcatagtctccaggttaaaaggtataacaggtggcagttgatactccttgaaggggtacactgatgtcttgaatagtgttagacaaaatccttatgttaaacaaaattaattccatttgtattatagtgaaaataatcttgcatctggtcaaagttttctatttctacttgagtggaaataagaattaagtgcaattttgctgaagaaacacagcttctactattcatgttttatttgtgaaaaagaaaataaaagtcaccataaaataatatttttaaaaagcccaggaaactcggtagctgggagttaaaagatcaaattaatttagaatcaatgagatgagatttgtgctaccctctgtagtgcctcccaaggacacttaacttctgtgaagtgattaaaagacgaaaaatcagcagcaatttagatctcagaactgaatagagcataatggaaagcggtggagctcccagtgttcctttagaggttcgcacttgatgtttctatgtctgcaacttctctttgaggacgtgccctgcttgccttaataactgtgtctttttgctaactgtagcaagacaataattttccttagcaagcactgattgtctcactgctgaaacaatgatctcatggaagccaatgtgtaatgaatgctttcaatttatgaaatgactgaacctgaattacaaaggatatataaatgagttttaaatgcagtgggcataaataggaatgcacatttacatacctaaaaagaaaatccagccattgtatacatccttgatactttgtatttgttgagttaggttggatttagtgactcatattcaccttctctgtaagtatttatttatttatttattcatttttatttatttttgagatgaagtcttgctctgttgcccaggctggagtgcagtggcacgatctcagctcaccacaacctccgcctcctgggttcaagcgattatcctgcctcagcctcttgagtagctgggactacaggtgtgcctggctaatttttgtatttttagtagagatggggtttcactgtgttggccaggctggtctctatctcctcacctcgtgatctgcccccctcagcctcccaaagtgctaggatttacaggcgtgagctaccacgccccggctgtctgtatttatatgtgaatattgttaattgagtgctttctgtagttagtatgtaaacatttagcacgttatgttatttcatgtatttcttacaagaactctatgtcttcggtggacagaattaacggtcccagtgatatccatgccttaattcacaaaacttatgaataggttatactacatgttagggggaattgaggctgcacatgcaattaaagcagctaattggctccacttgagatgggagaatattccggtttgtctgggtaccagccacaattgtgagagcccttataagcaaaagaggaaggcgagagagtcagaatgatatgtgagaaagactcgactggcccttgctggctttgaagatggaggggggacaaaagccaaggaattcaggcagcctctagaagcagggaaaggcaaagaaatggattctcccctagcgtctccagaagaattgcagtcctgctgatgtgattttagcccagtgaaatcaggttcagagttctcatttccagaactgttagataatacgtttttatttttttaagccactaaggcagtggcaatcttttacagcagcaatataaaattaatacgtgttccagtttacacttaaggataataaggcttaggtttcatactaaggttcacacagatgttaagtagcagaggctcctcgtagcgtcatctgtgtaaacaaactctactcacaacaacaacaaagctggcagcattccgggttgccccttacctcctgccctgaatttcttgcccatttggctacttaaatgctattaatatatgggaggcaacatgtcacacatcttcaaaccctcctccactgctatcttgttgactctgaaattcagactcagacacttcaagtagttaagcttcttgagctagtttgctgcttgtggttctttcttctttgaaactttcaagtcttttccttctctggtctctttgacttctgtctcaggattcttcacagtttgctaaccttaagggaggaatgaatgttctcaaaagcagaagagctgttccacttttcattctggatgagaattattttaaaaacatcatagctaacaaactgtacagttttaccacctaagtgaaatggcatctggtttaagtacacacatgacccattatttttataagttgatttcctgaagagatagaaaaaaagaaaaaaaaattcttattttaaaaaatttttaatggaaggcaagaagctgtccttcaccgtttggtttatggtccagttaacttcctttgttgggataaatttgctgctactctattttcttcacactaattaggcttattcttctgaggaagaatgggtttaaaaatatgctttacattttgactactggttgacttgaaaaaaaaatttctgtgcttttccagttccaaaaatgttttaattcaccagacatttctaggtatctttcatttattccaacatatgagttggaaaaaaaaaagcattcaagataagaccagagacacatcaagaaatttagaaacaagatagtactctttttttttttttttctgagacggaatctcgctctgtcgcccaggctggagtgcagtggcgtgatttcatttcactgcaaactctgcctcctgagttcacgccattctcctgcctcagtctcctgaatatctgggactacagtatatgttagtcgcagccacgcctggctaatttttttgtatttttttagtagagacgggctttcaccgtgttggccagaatggtctcgatctcctgacctcgtgatccacccgcctcggcctctcaaagtgctgggattacagatgtgagccaccgcgcctggccaacacgatagtactcttaagcgaatgtttttcttcgctctttttcattttatggctttacatttactgcaaatctgaaaacactgtgtcatcattcctaagcgttcaaaggcgttttctataatttgagagtttttcagttctttggtagccaaggattaaaggtatatatttgaaaaagtgaatattgtaccatttaaaagttttaaaccattcaaatcctaggaatgcaggtaagaaaaaaaggaggcttgtcagtgacgaagaaaaacagggaagtgggttgtataatgtataaagaaaccaagtttaaggaaaagaaagaactaaaataaataagaatgaaaattccaagaaggagtaaaaggtgggaaaaaggttgaatgtttgtgtccatttctgtgtctatataatcaatgatagtcccaatggaatgtgccatcataaaattcagaagtattgaaaaatttttttcctcaccttaattttttaggataaaagtcaaatttttaatcccaaggagaaaagatggatgttttattgtaaagcaaacatttagtatttttttcctactactgttataactattttgatgtactttttgtcaaaccattttgagtggcgtttagaaattaagctatgggaacttaaatgtgagcttgatggtacctgggacttcaggcaggaaacaggaaatggtgaagtaaattgcagtgccttgcaaatcacatctccactagatgtcaggctaggtctcctctgagtctcaggctactgctctatctgcctatatcagagattagtcctgttattagttccatgttaccaatccttcagacaactgaagatgctggtcctccagcatctttcacagaactgatctctggtcttccttccaacatatactgtgaactagatttacttgtctgataggacgattaaactttttgataactttaactctacactcaaaagctgtcagggtcctactctcctttaaaacttacattacaatctattttccacaatctggcatttaaatctttcatgattaagctaaaatctgtctcttgtgttctagatctcattcttccatctatgtaactctccactacagctaaaacactttgttattccttaagcctatctgccaatactgattagaggtacaggaagatttcaaaggttaaacattcagatggacacacttggcaaatatgtaaagttacagctttccataaggacactgttaggggttccccttctgtggaagaagtccccagatgcctaggctgcatcccacacagccagccctctttggccacctatatagtagctcaggttcaaggtagtgagagtcacatagggcagatgctgaattgccctggcttaaaaccctcataaaccatcgtttttaataaaaattccaaaggcacttcttccaagtttcctgtaagaaatctctcaattactagagttaaagtactcagcgtagctcatttcagtgactgctcatcaggtattcgtacatcatctgtagtgctttctagtccaaatgcaagtcatcaatccaagatcattgttatcataagcaatgttgcctagcaacactgttaactctaccttaatctggcctataaggaacagagctggagagttatcatgctgacaggaaaaatattcccttaattacaccatcataatcttcaccatattgtcatgccttagctcatgtttcctgtgtttggggttccctttgctcttcctttatttgttcttatcatttcagttcttcagagttttcctaaattactttaatctccacaaagactctcctggcttttccagtatgaagaaattatatatactattttaatgtatttgtatttattaattataatcacattttatataatcacatttataaaatttttatgtagtcactatagaggcagaagtaggattattggatcatatggtaattctattgttaatattttgaggaactttcatactgctttccaaaatgactatattaatttacattctcaccaacagtatatcagggttccctttcctccactttctctctaacacttatctttagatttttgatagtagccatgttaacaggtacggagtggtatctcgctgtggatttaatttgtatttccctgatgattagagatattgacttttttttgttggccattcatgggtcttattctgaaaaatgtctgttcaggccctttgcccatttttcaagttggactatgtgtttgcttgttactgaattgtttgagttccctatatattttggatattacccccttatcataggtataatttgcaaatatagtctccattctgtgggttgtctcttcactctgttgtttccttttctgtgcagaagctttgtagagtgatgtaatctcatttatctacattgacttttgttccctgtgtatatgagaaagctgaggcaggaggatcgcttgagcccaggaatttgaggtgaatttcagtaagctacgatcatgctactgcactccagcctgagcaacagcacaaggccctgtttttgttgttgttgttgttgttgttttagtttttttttttttttgagatggagtttcactcttgttgcccagactggagtgcagtggcacgatcttggttcaccgtaacttctgcctcccgggttcaagagattcacctgcctcagcctcccaggtagctgggattacaggcatgcgccaccacacccggctaattttgtatttttagtagagacggggtttctccctgttgatcaggcttgtctcaaactcccaacctcgggtgatctgcccgcctcggcctcccaaagtgctaggattacaggtgtgagccaccacacctggccaagaccctgttttttttaaaaaaggattaatttgtggagaattgacatatttataatattgagtcttcctactcaataactggtatctttacaatgctcagtcttcctacttctcaggctgaatggctcacacctgtaatcccagcactttgggaggctgagatgggaggatccctggaggccaggagtttgagactagccttggcaacatagtgagaccctgtttctaccaaaaaacaaatccataagtaaataaatcttccccttgaatttatgtaagtgttcttgcatgccactaaataaaatttattcctgggtattttatcttttttctattatgaatgatatctttttctaactgtaaagtcagtatgtgagaaatattaaatttaaatttttaaaaagcttttgaaataatcataatcttacagatgttggaagttcagattaaaggaacttatttttctagagcaatttgacattccgtcatccccatatttcagtgtgtatttttaaaaaaacattgttacataattacaatacaactatcaagatcaggaaaattaacattgatacattactgtaatctaatccttggaccccattcaaatttggtcagttgttctgataatgtcctttctagtaaaacaatccaattcaaaatctcatgtttttctggtcaatgtgtctgttttatgccagcaccatactgttatgatagctttgtattttgaaatcagacagtgtgatagttttagctttgttcttttttcttcagattgctttgactctttaggatcttgctgtcttgtctcttcaattctttcagtctggaatagtttctcagttttccttgactttcatgaccttgatactgggagacaacaaagcagttattttgtagaatatctttcaatttggtttgtttgatatttcctcatgattagatttgaggtagacatctttgtcagcaatatcacaggagttatttcatgttctccttccatcttatcaggggccatatgatctcagtttgccccactcttgatgatattcactttaataatgattaaggtattacatagagagctttccagttgtaaatgtactcttttctctttttaaattaatatgttttgtgaagatgtattttaaggtgtataaatattccatttctcatgaaatattaaattaaatacattgaccgttctttatttgggttaaaaaataaaaattaaatataggaactctggggtttctattttattcaaagagttttaaggagttatttttattatatattttgatcacattgttcatagtttggacagtgggagccacttcaagttggtttgagcatttctttgcttctgacacaatgggatttttcaagctcttttcatactttctttgtcttatccctggaatcagacattttccctaagagccctgttttgttttaatgaaaatttaagatctgggtgctctgtgcatcattgatcttaggatgccattactcccaggccctctcagtggacagatctagggaatacaaattcacatttatatttgtttgtaaatcaatttatatatatatatatatatatatatatatatatatgtattaaaaattgtgagtttacactgatttctttaatcctaatgcagcaccacaggctcattcttatcttctccctttctgtatttctaactcccatctctgaagtgataaagctttctcctattagctttaacataacacttttgagtagtttccttgtttgtaatctatcttccatattcactgccatccattctgacatttagctctgggacactccctctgtctcacacctcgcagctgtcctccttacctggttgttctgagactctgcacagtcccaccttaatgtggatgccctccacaccctggtcttggatgctgtgataccttacctttcaccctacctactcctggtatagatgtctaccatctgctgctgtcacattggttttaggactcactgttcgaggaaaaaggcaagctattgaattagttacttctggaataagccactttggcaagtactctaatgggtttctggtctatgtactttttttaaatctatataattacaataatagcaaacactgatttgtatctttctttctaatttctaaatcttgtgcatttcttttattaaattgtgtcctttggtactttcagaaatttgtagcactagtatatatctttatctcgttcctgaatttattgctattgcctctggtgtttcaacattaaacatgattctgtcttttggtttgatctacttaccagcttaaaaaaaataaacttttttcaatttaagctgctaagaactatgttgaattttactggatactttttctgtatttagggagattataattttaaaaatttcaacttattgtggaaaattatattgctatattctctaattgaattttctttgattatttggataaatcttactttgttgtatgatctttgttaatatgttgccgggcactataccctcgtatatatttttggaaaatattcatgtgtatttgtgagattaatctctggtttcctttttcatgttttgtcatatttgcatctaattgttttgcttgcttcatcaaataaatttgaaagcttttctatgtttcaatatttaacaagcatatgtattgtctcttccatgaagatttgatggaatccactgtgataatgccttgtttgatacctgtgtgtgtgtgtttgtgtgtgtgtgtgtgtgtgtgtgtgtgtttgtggtggaggaaaactgctttgagattattccccatttttttcaaggcaattaatttacttaggcttttctcttttttctaatgtcaaatataagtaatatacattttccttaaaaaatcatttttgtttagtttcagtttttttgaccttacatctttgtgtaaaaccttcttttctgatttctttttaatgatatatactgttagttagttcccagttttcttatgttgagtacttaagctattctttttgtttagatatgcctgtggtttactttttcctttccaaagaaccagctcttgatttttactttctatattttttctgttttataaatttattcattgcttttctttgttttctcctttccatttttcttatgtattttaattttcttgtactacttgagttaaaagctaattttttattttattctatcttcttgtaatatcagtcatttttttcttcagagaaatacatattttaactatattccataggttcatgaaaggcttcactatttttactttatattttatagttttagttttaatatcctcttttgatttaagaataaaatttggtacatgattaatatatgtaaaatctacatccttagtgattcatttcctatttgatttttgtttgacaacaaagggaagttattggggtttattttgcctccatttatacctgcaatttttgctttatgaattttgatggtatataatctgagaacaaaaatgtttaatagtttgattctatacctaaatcaaatgtctatttcttgatttatcaactttagaaaatgcatatttataacctagtatgaaatgagaaaaatttccctcttcacatgttgattttgttgcaacaaatatttaagtctttggtcagttatattcatatctttaaatgttattaaatattatttttaatatttcttaaactgtaactattaattatctactttgtaagggaatatgtacagatatatattacattttctcctctgctgaaacttcacatttgttactcattatttatactatctccattataatctatgaataagttatttatgttaatgtttacaaaatttgcctacactttattagtacattttgcatcctatttaagtcttagttgtatgggtatgtgatttcttcacccagtgcttactaggcgaaatttgatatccaaataatatctctgaggtttcatatttattagttggggaataaaattcatgagtcacatttttttcttccctgaggttgccctactctttgccaggacattgctgtggagaagtctgtgaccaaagtttttcacacttggagaaggcttcctcttttggcttgctgctaaaataattctttatctttgaaatatggtaacaattagctgctaatcgagtaacacctagaacatctaatctttttgtaaatcatgtatcatgatttctctttgcctttctgggtcatcgtattatatttaattctccagattcaagtgtttatataagaaaagtattattgcattatatctttgagcattttttgtctactcttatttctgtttgcttactcagaaatcatttttacatatagtatctgctccctattttcatttgttattttctcctttctttatgtgtttcctatttatttgaatgtgttagcctctgtgtctatggctatattttcttaaatctttgtcatttttgcagtttcccatgtggattttatttctgtcattattttatcttcctcttatttcctgaatattgcctgcttgtaatttctttctgttttcctatttatggttaatgccatgtaattttgtttttctttcatcaaagctgtgtgtgtgtgtgtgtgtgtgtgtgagagagagagagagagagagagagacggagaagcacagatttttgcttatttcctggcataattattattctagtgcatactgcatactatttgatttttatttgctattataaattaatcatttttaccttttcccttagagcatattgtgcttaggttccaggattattaaatagtggttattttttgaagatagattacttgttagaaaataaatggtggtggagagtgcactagttcagcagacagattgaattttcttgtatgttaatgttgaacacttttcatcaactttgttctgttctcttccctaaacaatatgctcctaatttgtgctgtcatcgtttaaattccaaaggttctgtgtagttatttggccatgatctatttcttttcagtgactgagatcagctgcttctatgttgattgccacttaacattgtcctctgtattatcacaactttattctgaaaaaaaaaaaaaaatgagtgttatgtggaaccgttgtttaaccccgcctttcatgaatgtcactggttcaaggatatccccttagtctgtccatgtctgaacatcttcccatttcaagtaaggtttagtggctgcatccttcagagctgtatcagcttcccctggagaactcttcctatttcctcaaacaagaccagtatgcattttctcttgtacctcttttacagtttattgatgtttcactatttggttgatattattcagaattcatagttagaaaatatggttaatcctcagttttactgaagatcaggcttcttcctctaacttttatgttttactctttatgttatttagtgggctgtttgtcatgatgaatagatttttaatgccaaaaaaatgacattgacttgatgttcaatctcatgtagatgggagataaaataattaaaatatgatcttctgcaagaagcagggtgtttttagatttttgaaagtattcctttaataacatttttacttccacttatctgtctttgttattttttcttgatttgattttcattgcatacaactgattctcacctgacaaattagagtcacattattattatttattcattataatttactaaatattatttaaatccaatcattatgataagttctagtgttttggttcaagatgaatagaaaatggaccctgttctaaggggagcatcataaatctgaagaaacatagatataaattaaaaagtcataaagaaagatattatttgctttagtgcaactattcttgtggtgctgtaagagcacaatggaaaagacatttacctttttctatggaagacgagtttcaaaaagtgtcactggttaatttctgaggtggatctaaaagtatggatgagttttttaagttgagtaatgatccaaagagaatataatatcaaaaagacaagatatgttcatggagcacccagaacatgcgttgttgaaagatggcgagaatgagggcaggtgctgtggctcatgcctgtaattccagcactttgggaggccaaggcgggtggatcatgaggtcaggagatcgagactatcctggctaacatggtgaaaccctctctctattaaaaatacaaaaaaattagctggacatggtggcgggcgcctgtagtcccagctgctcgggagactgaggcaggagaatgacgttaacccaggaggcggaggttgcagtgagccgagattgtgccactgcactccagcctgggcgacagagcgagagtccgtcaaaaaaaaaaggaaaaaagaaagacggagagaatgggggaggaacttagagggtggtgttcaatgaggtcacagaagttaatttaggtacaattataaaaagaatgtattacatacaaagggatttaaagcaagaaagtttaacaatcacattagaattttagaaagtactgtgagagtagactggaggatgtgttggggaggaagaagctgaactcagggacattagttaggccattattgtagtattacagatgagattcaaagagaacctgaaataagatattgagctgtggcaagcatgtgaataatactacttcacaatgtacatgtcacacagccctacttggtgacttctgattaacgatccttattgtcattgggattacaggagacacacagtcagtcttttgtttctgaggtttccctgtgcagactcaaccaacttgggatcgaacatattagaaaaaataaaaaaaaacgtaatactacaataaaaataacataaaatacaaaacaatacagtataacactatttaaataggatttatattgtattaggtattaaaagtgatctagagaagatttatactatatgggaagatgtgcataggttatctgaaaatattatgccattttatatgaaagacttgagcatctatggatttttgtactggaggggtgaaagaggtgtcctagaaccaacaccccatggatattgatggacaactgtattttgaaaatatttaggatatatttcaaaagagatggaattgacagtctttataacactttggtcctgaagaggaaagggtagaataagatctcaagattggttatagatacaacaacaaaaagagaaaacttcaggccaataacctttatgaacagcaatgaaaaaatcctcaacaaaatatcggcaaacccaatccagcagcacatcaaaagcttatccaccatgatcaaggaggcttcatctctgggatgcaaggttggttcaacatatgcaaatcaagaaatatgattcatcacataaacagaactaaagacaaaaaccacatgattatctcaatagatgcagaaaaaggcttttgataaaattcaacatcccttcatgttaaaaactctcaataaactagatgttgaaggaacatacctcaaaatgataagaaccctatatgaaaaacccacagccaacatcatactgaatgggcaaaagctggcagcattcctcttgaataccagcacaagacaaggatgccctctctcaccactcctattcaacacagtattggaagttctggccagggcaatcaggcaagagaaggaaataaagggtattcaaatagtaagagaggaagtaaaactatccctgtttgcagatgacataattctatatctagaaaaccctgttgtctcaatcccaaagcttctcaagcttataagcaaagtctcaggatacagaatcaatgtgcaaaaattgctagcattcctatacgccaacaacaggcaagcagagagccaaatcatgagtgaattcccattaacaattgccacagaaagaataaaatacctaggaatacagctaacaagggaggtaaaagatctctacaaggagaactataaacaactgctcaaataaatcagaaatgacacaaacaaatggaaaaccattccatgctcatagataggacagataaatatcattaaaatggccatctgcccaaagcaatttatagattcaatgctattgccattaaactgccattcgcattcttcacaaaattagaaaaaactatttaaaaattcatatagaatcaaaaaagagcctcaatagccaggcaatcttaagcaaaaagaaaaaagctggagccatcactctacatgacttcaaactatactgcagggctacagtaaccaaaacagcatggtaccagtacaagaacagacacatagaccaatggaacagagtagtgaacccaaaaataagtccacacatctataactatctgatcttcaacaagcctgacaaaaataggtaatgggaaaaagattccctattcaatactgggaatagggaaaactgggtactgggaaaactggctagctataagcagaaaattgaaagtggaccccttttttacactatattcaataattaacttaatatggattaaagatttaaatgtaaaactccaaactataaaaaccctgtaagacaacctaggcaataccattcagaggcatgggcaaagatttcatgatgaagatgccaaaagcaattgcaacaaaagcaaaattgacaaatgagatctaattaaactagagtttcttcacagcaaaagaaactgtcagcagagtaaacacacagcctacagaatgggagaaaaattttgcaaactatgcatctgacaaaggtctaatatctagcatctataaggaacttaaacaaatttacaagaaaaaaacaaccgcattaaaaagtgggcaaaggacatgaacagacatttctcaaaagaagacataaatgtggccaacaatcatatggaaaaaagctcaacatcactggtcattagagaaatgcaaatcaaaccactgagacaccatctcacaccagtcagaatagctgttattaaaaagtaaaaaaataacagatgctggtgaggttgtagagaaaaaagaacacttacaccctgttggtgggactgtaaatcagctcaaccattgtggaagacagtgtggcaattcctcaaagacctaaagacagaaataccactgaacctagcaatcccattatttgggtatatacccaaatgaatataaatcattgtattataaagacacatgcacatatatgttcactgcagcaccattcacaatagcaaagacatggactcaacctaaatgcccatcaatgatagactgggtaaagaaaatgtggtacataaataccatggaatactatgcagccataaaaaagaataagattatgtccttcacagggacatggatggatttcgaggccatcatccttagcaaacaaactcaggaacagaacaccaaataccacgtgttttcacttgtaagtgggagctaagagatgagaacacatggacacatagaggggaacaacatacactgagacttactggagggtggaaggtgggaggaaggataggaccagaaaaaataactaatggatactaggcttaatatctgggtgatgaaataatgcatataacaaaccaccatgatacacgtttacctatataacaaaactgcacaacctgcatgttccctggaacttaaaagttaaaaaaaaaaaatagattggtgacaaagttattataattggtagggattttcttaatccagacaaaattcaggagaggatcatgttttatatggcaaaataaacatgggagaaattttgagtgaagttttggttatcttgagtttgcttttcctgggcaacattcacgtgaatattagtggagcactggttagagatctgggctggagagtttgatttgagaatcttaagatcaatgtgatcattgaagacatgaatgcagataagattatgcaaaaagaggatctaagctgagaagagaagacaagggtaatgagaatggattcttggccaacgtcaatgcttaacggaagaagatagcattcaatggagcagtctaataatgggaaagcaagaaaggagagaatggtgtcacaaaaacccagtaagaagaaacttcagtatcaaacatcacacagggcgtagtaagatgaagactgaaaggaggttatttgactagaatctaaaaggtctctgatgatcttaatgaaaaaaatttcaaaaaatatgaagaagattaattatagtagatggaagagtaaatttgggttggggaaatagaaaagataaacgtagattattttttccaaaaatgctgggtataaagagaagttattttgataatttgttgtaaaacattgcccctttcggctgggcgcggtggctcacgcctgtaatcccagcactttgggaggccgaggtgggcggatcacgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaacaaaacaaaacaaaacaaaacaaaaaaaccttgcccctttccgtttcatgtgtccccaccactcccccactgcccccattttctcttctcaggtaatacagttctattttaacatcttaacccacccagtcaatgaacagggacaatctaggcccacttgggaattgtctctgtcagtgtgccagcatttattaatagaaaactttgactgggcattattcttttgcctctgaaggtttatttagtcaccctttttgggtgccttatgtctatctaatattatattatttaaagaaaaattacctttgagattttagaaaacaaaaactagttgaaaaatgggtagatacactatgaaccattaacataggtatgtttagtgacctcactagataggtttagacttattttaaaacatactcctccctgtaattaaatcactaatccaagtatataggaagacttagtcatgcttattgtctctgaaggatccttttctttattttctcccatccagcttcttgttcagtacttcagtcctatgctagaattcaccttctgcttattattgtataagggttgctattcttactacaaaagtttgttgccagtatttctgttgctatggctgctgaactgcttctttgtgctctaaaaatcatattaagcaaggttccatttatcattggattaattattagagtatgtactccaactactttgaagccattttacactgtgttttccagctaactctgctctgacatttccgcaggatcattgtgatatttttttctagggctatgctgtccatctctttcttgcctcctagccactcagataagcctggtctctgagtaaattgtggctatgtatttacagaatttctaagccttcacttattctattgcttcctcttagctttttgcaaagggtatttatatacctcttaaaggaaagcttgttggggaaaaatagtttagttacgtttaacacaaaaaacatttctaacttccatcacatgcatacttaatttactatatgcacacatatgaagatatatctaccttaaataatcattaacacatataaatgatcatcaatataacattcaaacaaaacattggaatttagttcttctattccaataatatacagtgggccttatatcaataaagataatcggttttttaatttctcaatgggttcctagttaaagattaattttctaacccctttccagccctctttcaaatatactctagtctaaacccttgattttaaccgtgttatagggttaagtcttttctgcttctgtcaaaagccaggctaaggcaaatccatcaggaaaaacaagactggaaaacaaatgtaaactttatactctttgaacctctttaaactttatccctgtattaaatttgatcacaagaaaagctcaacatctggtctttacaaagttacaatttcatgttgaaacctttggctttttttctttttaatgaaactgctttcaaaggcaagatccattatgttgctcaacaccctccacggaaagagccttgcaacaaatacctctcagaactgaggatcagcaaagagatgttttgatgaattaaagtgttcttctactaggctgtgagtgctatccagcccattctatttttgagtttacttggctgttccaagcctactatgaagccttgacctctactgctatagcttttctcaggcaatgttaatgttagataaaaagcaaagtagtagtttaatccttctattctttgctagcaattcttaatcttatcttctctgttctataagtcttatttttttgtcacctgctttaaatgaaggataaagaatatttacttttttaaagcctctcttttttggtcagaattccttaaaccttgacctttttccaaatctctgtggcaccatctccctttcctgtccctatcattcatcagagctattactgacactcttcttgaacaccattagaaaaacaggctaaatgaatacttcatagaagttccttcctaatctatgtatataaaaatctatgattaagattttatatatcagaaatattactagactaaaaggtagtttagatatatgtaagctgacagcttggttcatttaaaataaattattccatatgacgctaacacacaatttggtaacttttttgtttcttaaggcttacctgagcaatgtgggtaagaaaatgcctaaatcatgtaatcagtatttccaagtttattatgatatgatttatatgatatgatatggatatatatgatatgatatggataacaatcagttgtctgcttaaatttcccttatttcaatttcttatttagaaaagcagtatttgttattggtgattaaaaccaatttgttattggtgattaatctaaaggatcacaaaatttttataccaagtcaaatttaatgattcagaaaactagaagtaaaaacagataagtttggatgtcaaattccaattcttcataattagaatgtggtcaatgaatgcactttttaacgtttgagaaatacattaaaccactgattttctcaataacttttcactaaagaaaggagtaatatgcctaagtgagtatttattatttttttttacaacagttctaatagcactcattcttctgcagtaagcagaagcccatcactgtaaagatgctataatatgcaatgctctatcttcctttccatctaatttgaaggatgtccgcccattctggcactgaagaagaatgacaattagtttgctttttggctatgattactatctttctgctcttaaagactcctttatgatttgcttacatttgatctttagaaggaattgcaaactgaatccagacactagaaggtgctctgaagagggggaacaaaagatggggacctgcgtaggattgaataggccgacataagtaggattgaatcgaagggcaagagtgaaagtgagagaccaaattaagaaaactcttactcgaattgtcatgtctgaagttctggaaccagttcatcttgtaacagtgttggatagggattctgcatggcttgctttaagagaagtgacattatatgaacacagacaaacttcagcatttactggaaataaaaaaaaatgccagaccagatttgacatcaataaaaaacattaaattctttcctcaccttaatcaccctatgcagttctacttgtgtattaaacaaagactgttaatacctcacttccatagtcactgaattctttcactatgatgaatgtttgcaattaaactctatttacacacttgcttaataagattatggaaaattactcaaatttttaattgattttttttcagacttgaaaaagtctaagcacattaattatggccagttgaatgcattatgccacattagaggacaacacaggtaagctattcatgcatttctttttctgtcattcaaatgaatatgagtatttttgttttagggataaagtatagtaataaaccattgctggctctcagaggtacctgatttatcacacagataaaaacagttgaaaacctgggggttatttcttcagattgaaggggcagaatatatatgtcacatcttaaggaaacaatttagtgtgaaacaaacataactcattcctagctggctctttgtagtacttaaaaagcagtcataaggggaaaaagccttaagtggttgaaaacacacatactgaatgaaataagtacctgagcagtgaatagggaatgcctcattgaaatatactggaaccagagaactaggaaatatcactgttcaaagctcaggattcctaagatgtgtaatacttgaagatttaattttaagagatctatttccttgacaactcctttctccaagttgggtttttggaattataaaactggttatttccttccatatgcatcagtgtccatccaccctcttaccttccttcactcatccttcatgggactgttgaggaaggccttaggtttacagagttttctctctctactttaaaacatctccaagtcacatccttgtactttgcaatccatttcaaattatttttatactgttgtctattttctcatttcttctgtctcagagagagagaagaaggcatgcaactttgatattgcttggatttctgtcaagagggatcattttcccctgtgcattgctgcctcctccttgcacccagtgcctttcgacatggagtaaagaatgaagtccacacactcccgagacctattgcctgatgtgaatcctgtctcagccacttaccctctgtgtgactttagactgcttactacatttctctgccttggttttttcattggtaaaatggagataacagtactcactttaaagggttactaggatgattaaatgagcctaatatatgtaaatagcgtctggcacatagtaagggttccagaagtgttagttatttttattatttttgttatgcaaaaaagctcatccaatattttaagtgtcttgaaaaattttaacatccaagctttgaatctatcttatatgttggtcccttttctaatgcatgagatgctaatcaaggctttgaatgtcctttttgctttcattttcgttttgctttctggcccagacgcatttcatttttcaaaatacttctagtttttttttctctttggggggtcataataagagagcttgaatcatctagagctagttctctcaaagtatcccctctaaataaatgtgatcagccttactcttcctggattgaatcattcctcttgggtggtgtcgtcttgtgagacaattatctcattcaggtccaatctggctgtactgcctgactccctctagtaagtcttatgtttactatgtcttttgttagaaacccaaatcctgaaattgttggatgtgttcttttggagcactggtacacaccaggggcctgggggaacaggttttaaggtatgtgtatataggttttgcatcattctgttagaaatacaatatatagttacaaatacaaaatcagataggaagataaatatttatttggaatgaggataaaattacaacaaattaataaaagcttggaagttcaggtcccttttctcacttgacatttctttagacaatttaccagaaatacattcacaggaattatttaaaaacttcagaattcaagtgatgtcaacaaattgagaggcaatttaggaaaaatgtatttctccatattattagttctttatgtattatagatgaaaagtgaccaataaattacacttttcccctataataaaaatagaaaggctgagaattaaatgattcaaggttttaaatttttgtacatagaactcacaaagggcattagttttgattctaaaaagtttcttctgttagaataaaggcagtaggttggtatattatcctgggattttttattgaagataaaataaaaaattaataacaaaggggggatgatatcactttggatttctaaatttttgagtgcaaatttttcatcctagtagactacaagctccatgaaggcagatttattttatttattttagtgcttcctactccttgacatttggcatagagttcaatgttttgcactggattttattttgatgttcagtagaaataaatatcttctgatgattcaaaaaaatgtacaagagttttctgtgttgattataaataagttaggatagatatggatttatagtgtttttttaactattgtctggagagcggattatttttaaatattttaatcgggaagtcttaattatatacatttttgtgataaaatatgtttttgtatatgtatacaatgtggaataattaaatcaatatgtttaatatatccatcacttctcttacttttttgtgatgagacatttgaaatttgctcttctggctattatataaacaatacatttttattaactttagtcaccctgttgtgcaatagatcttaaaatctttttactcctgtttaattgaatctttataccctttcgtcaacatctccacattcctccccagcaacctggctcctagtaaccaccattctactctctgcttccacgactttcatgttttcagattccacctctatgtgagatcatatggtatatgtctttcggtgcctgctctatcttacttagcataatgtccttgatgttattcatgttgttgcagaagaattttcttctttttaagaccgaacagtattccactgtgcataagtaccacatttttttagccgtttattcactgatggacatttaggttgatttcacattttggctattgtgaacagtgctgccataaacatgggaatgcagatatctcttccacatattgatttcagtttctttggatacatacccagaagtgagattcctgcatcatatgttaattctatttttagtctttctgaggaaactccatactgttttccataatggctgtactattttacattcccactaacaatgtacctgtatgagggttcctttcagttcaggtcctcatcagcacttacctttctttttgataacagccattctaacagatatgaggtaatatctcactgtggctttagttttcatttccccattgattagtgctatcaagcatttgttattttttttttcatgaacacattggctatacatatgtcttctttggtaaagtaggtgttcaaaaactctgtccatttttaattgtttttttttcccttgctactgagttgagttccttgtatatttggatattaattccttatttgatatatagtttgcaaatattttctctcattctgtaggttgtttcttcacttcgttgattgtttccttggttgtgcagaagcttttagtttgatgtaatctcatttgattgtttttgcttttgttgcctgtgctttcaggtcatactcaaaaaatcgttgcttagaccaatgtcatggaacttttcccctatgttttatcctagcagttctatgtttaagttttagatcttttgtatttaatcattttgagtttatttttgtatatggtgagagataagggtctaatttcattcttctgctgtggatatccagttttttaaagcaccacttattagacagactgtcctttttccattgtgtgttcttggcaattttgtcaaaaatcaatttattataactgtgggtttatttctgggttttctatcctgttccattgatcagtatgtctgtttttataccagcatcatactcttttgattatactagctgtataatatattttgaattcagggagtgagatgcctttggctttgctctttttgcttgagactcttttggctgtttggggtctttagtagttccatgcaaatttcagaattgttttttctatttttgtgaagatgacattggaattgtgatacagtttgccttgaatctgtagatcacttttggtagtatggacattttaacaatattaattcttctaatcagtgaacatggatatccttctatttacgttttcaatttctttcattagtgtttcagtatacagatctttaaacttttttggttaaattcacacctaagtaatctatttttgttgttgctatagtaaatagaattatttttctaggatttttttgggtggtttgtatatagaagcatgactaatttttgtacgttgattttgtatatcctgcaactttactgaatttatttattctaatagcttttggtggagtctctaggcttttatacttataagatccatattgtctgcaaatagagagtttccctgcttccttccctattgggctgtattttttttctttattttgcctaattgctctggctaaaactttcaatactgtgttgaaaagaagtagtgaaagtgggcatacttgtcttgttcttgatcttagatgaaaaattttcaacttttcacctttgagtatagtgttaactgtaggcttatcatatatggcctttattgtgtttaggttcattccttctgttgagggtttttattattaacaaaggtcaaatacttataaaaactataacccatgaacagttggatacttataaaaactatcacctgtgaacagcttttagcccaaagtccatttataaattaattgtcaagcattcagaattttccaaagacacaatatgatagaatcatagaattgtagaacaggaagtcaactcaatcatctagtggaaactctttaacctaaatatgattgttaatcatcgttatttaaaacaaaagaactaactgacaaagtcatagagtacccaattttccctcatttgctcaaaatatatctgaaatgttatgcttttataataaagaagaaaataacattttaagatttatagtaaatctttaatgaaaaaattaaaaattgagtagtttctcattgtttcagtacatttaattagaaaagtattaagagttcgatagagacaattatgatgattttaaggaggttcctggaaaaccctttacagtatattcgttattaatttttgtttcaaaatatcttactttcctttttcttcccttttttcactcacaggatgttggtgagaacctttctttttcttaatgagaatgttttgataattctgttggctttccggacataattagacatgtatttttgtcttaagaaataaagaaatgaagagataggggacttttatttttatggatataaagtttggaagagaaaggaaagggaggagagctttaaaaggatggtttatgtacacataaaagaaatgatctgagcttcgagccattaaacattgctttgtctggaatgaagccattttttattttgaggtttcctctgatgaccactagctggcactctcaatccagaacagccctgtcttttgggatggcagaaaatgtgggcagagataggtgggatcttacatttattcaataggttgttaacaagttggaggcttataattcaaggcatgcctattcataatgttttacctaacgtgtacactcttatagccaattgtttaggcgggattttctacctagggcagtaccttcactagggagcatttgaaatgtatacacatttatagttattaccacgactagaaggaagtgggggattttaaacctttagtgatgtgaagtaaaatcttgcacactgtcccaaccaaaatgtcaataatcctccttctcccatcttcccttccccttaaggaacactggtctagatgatattatcttaaacttactcaaattagaggagttgctatagataatcgctaggatttcattaaccttcagatttccctagatcttgatttcagaaacaaatcattctttcctgaaaacttgctttctttctctatttctatccatatcactacagttagcctgtaaactcctggaaaaaaaagcaaccctattagtttggtgctcttgagagtttttattgcttatttcagtgcatgatacatagctgacattcaaaaaatacttgtggaatgcctgcatttacccagtaattaaagtatgaaaatcttgcaggcatgttttgttaccttttctctttatttctccatgtgttataattagattctgctgttccattgtatctctattgtttatcactcattttttaatctactactccactctagcttttattacctgaatccaggactaccaaacttataagtggaattacattctcaaatctcttctcatcttaattccacattatgtactacaagttaaatctattttattcatatattttaatagattaatttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccgaagtgctgggattacaggcgtgagccaccgcgcccggccaatagattaatttttgaataattttggctttacaaaaaaattgagtagaaagtataatttccatacataccttgacccctccttcctagtttcccatatgatcaatatcttgcagaagcatggtatatatgttgcaatttttagccgatgttgttatttactattaactaaagcccatttacattaggaattactgtttgtgttgaacattgcagggcttttgacaagtatataatgacatggaacaaccattccatgtaatgacgtgtgttcaatgttacagaataattttactactctaaaaatcttctgctccatctcttctccctcccttctccctatcctcaacccctgacaaccactgatttttttcctctgtttccataattttgccttttttagaatgtcatatagttggaataatactgtatatattattttcagattgccttctgtcttagtctgttttctattgctataaaagaatatcagagattagataatttataaagaaaataaatttatttctcacacttctggaggctgggaagtcaaagggcatgagactcgcatctggcaagggtgatctaatggtataagagtggaaggcgaaagcaagcttttgaaagatagagaagatagagaaagacaccaaggactagacttgctttatatcaatctcatgataattaaccttctaatgtgataatggcattaattcataagtcataccctcatgactcaatcacctttattaagccccaccttacaacactgtggcactggggattaagtttcaaaagcatgaattttggggggcacatttaaaccacagcagcttccttcactaaacaatatgtatttaaatttttttctctgtgtgtgtgtgcatggtgtgtgtgtgtgtgtgtgtgtgtgtgtttggcttgatagctcattccttttattgctgaataatatttattgtatggatataccacagtgtttttatccattcacttattgaagcacatcttggttgctttcaagttttagcaattacaaataaagctgctatgaacatttatgtgcaggtttttgtgtgaacatgggtttttgggaaaataccaaggagcatgcttgctgaatcatatgataagcttatgcttagctttataagaaactagcaaaccgttccaacgtggctgtaccattttgtattcccacccaaaatgagtgagtttcttttgctccataacctcatcatcatttgtgttgttggtgttttgaatattaggcattctagtaaatgtgtagtggtatcttgttgctttagtttgtaattccctaatgacatatgatgtttatcatcttttcataagctaatttccacctgtatgtcttcttggatgaggatctgttcagattctgtctgttttaaaattggtttctttgttttcttattgttgagttttaagagttctttgtagattttggatgccagctatttatcaaatatgtgttttgcaaatagtttctactatttctatgtcatttctgtgtcttctttggagaaatgtttattcatgtcctttgcacattttttaattgtgttgtttggttttctattgagttgtatgagttctttatacattttaaatattaatcccttatcagatatattttggttttcaaatatttttcccaagtagaggctactattgagtttatttttgtgtatggcataagataggggtacaatttcattcttttcccattttaaaattcataaggaaacataaaggaccccaaatagtaaaaacaattctgagaaaggaaaacaacgttggaggcattctatttctaattttaattattttttaaaaattatttttatgtattgtttttaaattggtatataataactgtacatgtttgggggtacatgtgatacccccaatctttataaaagtaccaatggcattcttcacagagtaccaatagtacttcgttaaagattgcattgaatctgtatattggtttggataatatgaacattctaacaatattaatttttctgatccagggatgtctttggggcagtgtatatctttctatttatttgtgtcatctgaaatttcatcactgttttataattttcagtgtacagatctttcaccttcttggtttaatttattactaaattgggtttttttgatactatcataaaggggattgctttcttgattcctttttcatttgtgttgttatttgtgtataaaaatctactaattttttattgactttgtatcctgtaaatttactgaattccttcattagttaaaaaatcataattattaaaattaaaaactcaagaccactctttgcagcttcctgtcagctagatttggccataagacagtgagtgttcttgccaacagaatgggaaaagtagttgtagaaattctgcaacatgagttaatcacaaaagaagattgatacctaaagtatgtaaataattgctacaaataacccaatagaaaaatgggaaattgctatgaatagaaaatcatcaaaaaaaattaaaatggccaataaattcatggaatacaaattaaacaagacacaaatttcatccataaaatatcaactactataaaagtttgataacttcaagtcttggtgagaatgtgggaaaagatctgctctcatatgctgctggaaaagtggcagatgtatagggagaatcaccagaaccaatttcgtgggcatgtgacttatgctccaaagggcctcatgctctgctgtcatcatcttgaaatgcttagtaatttttgaacaagctgctcacattttcattttgcactgggccccgcaaattatatagctggtcttgaaactcaccaaatcagccatgatgcaatgaaaaaacaaaaagtacctcaatatttgaaacatatgggtgtttaatacagaaatctagttaccaaagagttaaaagatccaaaagaggagggtgagttaacacaaataagtaactgcgcaaagtggctactaccctaagacgggggccttgaaagagcagacatggtatggagtatgaaaagaggctctgggattgtctaggaggaaccacccagataggctagaactgctaagaagggaccagaaagcagatagtgagtctacccaagaatggctaaagatagtgggtctacccaagaatgcagatagtgagtctacccatgaatggctgaaggcagaggaacacagccaattccagaaatgtcaccagtaacaggataaagagaaagcaaaaatataatgtttttttcctcttctgatttctagtctactacctgcgccttctattggcaaaatctaataggataagacagttggcaaggaagcctatgaagtgcagtttgctaattcccagactcaacattccagaacggatagagagtgcattatgtgtttataattaactattacatgcccagtaccctaaaagtacctcttagtattttaccccagagaagcacccacacataaataggaaggcatttacaagggtgttcactgcagcattttttttgagatagaaaaaaatgaaacaactttagtgttcatcattaggggaatagttaaataaagtatggcatattaataccatgaaatattatgaagaagttaaaaagaatgacatatctatttgttcaaatatgggcaggtctctaagtcatgttgtggatgggaaaaaagtaagttgcagatagattttataatatggtatatcttttgtatacaaagaccacacacgtaaacataaatctgtaaatatctactggttcactgaaatgtatataaagacacaaaaaagattaaaagaatattcactgatttaacatgggttttctctgagggtggtgaaaaagttcaatgttaagtgatggtcagaatagtggtcaaaataaaattcaaagtaacttacattgttttcaattttacaagagatttttctcttgcttgtatactctttgaattactaatttaaaaagaaatgaatactcagattcaagacttactataaagctacagcaatcaagacagtgtggtattagcaaaatagacaagtggatcaattaaacagaatacagagctcatgaatagacccacacaaatatgtcaactgatctttaacaaaggagcaagccaattgaatggagaaagtttggattttcaataaatgatactgaaacaactggatatccatatccaataaatatatgtgtctaggcagagaccttacattattcacaaaattaactcaaaatggatcatagacctaaatttaaaatgcaaaagtataaaaccatataagataacaaagaaaaattctaggtaacgttgggtttggtgatgacttcttaggtaatacaccaaaagcatgactgatgaaagataaaatgattaagctgaacttccttaaaatttaaatcttctgctctgtcaaagacactgttagaagaataaaaaggcaatgcaatttacctgtgtaacaaacctgcacgtgtacccctgaacctgaaataaaagtaaaaaaatagaaataaaaaatgtggtttatatacccaatggaatactattcagccctaaagaagaatgagatcttgccatttgctacaacatagatgaacccagaggcccttatgttaagttaaataagccagacacagaaagtaaaatactacatcatcccacttatatgtgaaatttaaaaaaacgcaaatacagagatagagaacagtggttactaggggcaagggtgaagggaggaaatggggagatgtaggtcagaggatacaaagtagaatatatgtaggatgaacaagtgaagagatctaatatacgatatgaggattataggtaataacattgcactgtatttggaattcatgctaaatgagtagattttagctgttcttgccacaaaaaaaaaatgggtaactatatgaaatgatggatatgttaatttgcttccctatagaaatctttttattatctgtatgtattctagaacatcatgttgtacacttaaatatatacagtaaaaataaaatttaaagatactaaaaatatatgtaattttcaatttgagaattttcacttagttcttcaagtttgactggctattcctgatattctcttgttattaatcatcattgtgattccctcctttattttcataaagattttatatataacttttatattttatatctaacatagagtaatttataggcttagggatataaatctgatgttgttgctgctggcttgcgcttatggcagcttgtctttccaggtgatctttctgtgaaagatttgcttattaacatgtaatagtaacatgtggcctaaattatgaaaaattcttcaacagagaatttatatctatctcttcctagggtcagtgtgcaccatcaagctaagctactccattctccttcaagagtccttccacaaagatggctgggctcccctccttgttccttggtcatggctcaattcctcccacccatgctccttcgtatcagtgactgccttcagcacaccctacccctcctctctgcccattggtcacatctcaagtatccactcactttcccccctcttttcttgcaatgtggtgggcctttgagacctaggtcacctttcataagaccaataatgcaccagaaatttgttatgcaggatatgtgcaacaacagggctctttagagaattaagactgccatgctgcaaaaaccttgaagattttttttctttttttgcattttggcatgtgtgcgtataaggtatgttctaaggtataaggtatgttcttctaaggtataagatacgttctacactacaggaatatgagtgccagatatttcctttttaatagttctgttctcatgataaaagtttttcctgagtctgtgtctaggtagtttttaataaagaaatctttctcataactagattttttcagtcttaatcgcatttaacatgacaggcattgcatttgtatgtattgctacaggaagatttgatcgtgactcacattcttgtccttttttccattaaaagtgaggcttctagccctgtgattttaataaaatttttaaactgtctgatatctaaatgctgtacattctgtacctggatttacattaacaattaacatttttacttgcctaatagactataaacagtgggcctgaagttttacttttattatttctagctactataacaatcctaaagataggaagtccttttctaaagataaaaaaaaatgaaaggtttaaatacttcatataaggttacaggacttcagttttatatgcaaatcagatattgattctcaaagtagggagaacttaagttagttatttcaggggaagtaaaccttttatgactgatcaatatctctctaagaggtttacattcaatcttgcagttaactttgtcaaacagatctttaaattttccttcagaactttatgaaaatgaaaagtttgagattaatcttaatatttaattgcaatggcatgtggaacttctttgaaaaaatataattttgaaggcataaaatcattggctaatgagctttgtccatgaataaggctagaaactcacatttccaaaaaatttttaaataagaacagaagagactgaatagcatgaaactttgtagtggcctaatgttaaatacactgacatttttatggaatgtttatttttcaactcattgtaataaaaggatgacatacattatgaaaatgtgtttatatatgcaatatgcatattgtatatataaaatatagagtcagcttaattcataccaaattgtacctgcctcctttatcaggatatcacttatatttcttttaattttcatcaaatacatgtgtagatgctatgatatttgtaagacaaattcaggaggaaacaatatataagtgaatgaatatattcaacttttatgatttgccttagttaacttaaaataaaaaatgtgaattgcctcgggcaaacacataaatataattaatcaataaatatcttattaaaagcttattatgttttcagacctgtgagcaaaactgaatgagatgcagaagaaatattgtattagggtatttcgggctgctatagataaacactaaatctcagtagctttgcacaatataattttatttctttcccacataatgctataaaggggtgcttttcattgacagtttgttcttttagtttaggaactcaggcctctaccaaacatttgctcttcagtctttattgtgtggcttccagggccaccttggtcctctgcatcaagctggatgggaaaaggacattgagaatcttatgtggaaggatcttttttggcacatccttctgccttctctttcatattccactgggtagaactcagccatgagaacatcgagtagactagcctagaccaggggaagggtgatcacttaaagcctttggtagtattccctgactgtatgacgtgttacttcctgccttctctaatagattttgcctctgatgagaaatggaagacccttaatcttagagcaagacaattggaatgtgttcactcatttttctactttatataagcgtaggcaggtaatttaaactttatatgcatcatttccttatccataaaatgacaaatacatttctaaataataatacatccaaatctaatatagtcagtgattttatatctaccttaaagtcttctgtatgctcctccaaactttatctactttttgggtacacagctagactacatttaccaacctcccttgtagttagagagactgcatttatcttcaaatatagtcacattgggtgtcagagctttaatatatacctttttgggagttggggggggagccatacaatccatagcagttattaacatttaaaaataagtcatttttacatgagagtacagatctctgacttctgtagaaaactacaggatctgaatacactgaacttcttttaatacatgagaaaaatggtcttaagggtgaggtcacaggtccctccatgtgggcatgctcttttcagcttaccacagttcccaccttatgacacttgcttggacacgataagcatttaattttataatccctgtatatagagaatcctgaaagtgttctagagttctgctgtgtaaacctatatattttgaatgtatttccctttcatctgcttgaggaagttggagttattttcttatagatgagtttattgcaggtaagcttcaatgaagtggcaacttctttgtccatgggtaggatttactcatagcctggtaaatcacgaaaaacatcttcaggacagaattgaagggtcagataggtatttaggtccatgatctactctccaactctaccataatgctaaacatttctttgtccctagcatgctaattattttatgtttcccctcagctacttctatattccatatttagatacatttatttacagatttcacatggttttagacaataatacttttctactgaacacacagacatatgttgttgtttcaatgagaccctcagaagtaggaatatgttccacattacatttttgggacatagaatataaattatagcattacaggccatttaggggctcaatctgaaaaatcatgtcatctctagctctagcatttgactcttccatttcaaccttccacgtatttcacttcttggacacactacttttggagacccagatcatagacactgaatccatgtacattacccaccacatcttggaaattcttgagaattaggtgaaggaggcagctaactaaggttatacacataaagtgtataagtgtaactaaggttatacacataaaaaatgacttgggtaaaagtcttagtatttggaaataaattttttatccactccaaagatgatctatccagagcacaaattggaataggattccaaattttgtagtataggctgcatatgtctacacttttgtacttctttggacctcagtatcttttcaggaacaaaatgggtaggagtatctagttaatacagttatgtaagatgcatatacattacttagaagagtgcctggcacatagcaagaactaatgtgttttattaaatgggggacagaatatcccagaggttaaaataatgggttttggagtcaatttagttttcatttgtaccgtatatcctccacttcttagttatatgaattaggcaaattattaaggttgcagtttctttttgtgcagaagggtcaataaagtatctcaaataaagtatattgtcaggttatataaatgtgcaataatacaaaacagtgtaaaagatcttagtacaatgattcgaatataacaagtatccagtgaaaaacaggtagatgtgtaaaacagatgattgtagaatgtgagttacaaacagaatttttttttttttcctgggaagcctctaataaatcagtggtcagattttaaaaagattcgatgcttggtgaatgtatctatacactgtgagaaagtgaataaaaatgcctaatatagaaaattacatcatattgtgttgtttgaatcaattatgttacatgaaataagatttttaaagtctatagaatttgtcttgtgtaaagcatcaatatggtgttttaggaacattatccaagagaagaaaaagctgttataaatatttcagaatgtgttgttattatttacaatgaaaatgaaaaagactttttaaaaaagccttctcttgaggattttgttgttcattgtcatgcggcaactattggctaagatgtttgtcagtgttcaatttgaagtatgataattttttataattattgaaataagctctcaagatgaatgtttagcattttttaaaaaattgaccaacttttcatggtgttgtcaattgaaaattgaattaggtggattttccagaaacaaatatcattacctaacatttaatgacaatgctattctctgaatcttgcttattggcatttttggtatttgccatgaatcaaggtgtagctacatataagagtcatcctgaggaatagatttaaaaaagagaagcccacccagggctctactgttggagtttatgattatcaataaatggatcagaaatttttacttacaaaaagcatcgtaggtaatttcagtgatctgaatttggaaaatgctcatcttttgttcttgtaacatatctttattctagacctaaaaaatactgcctgcgattttaacacatgatggcaaagattcaaataaatactctctctagtaatgtagatgtaaactattttaaataatttcagggggattttaattctgtagtacattatataaaactttaatcaattatagaaatatgagttttaaaaagactgaacttcaaaaattaaatttttgacattgacattatcatacattatcatacattttgtatttcttaaaatgtttctcactgagatttggatatttttaaagcacaaaatatttatattttatatttttgttagttgcttcttagactaaatagtatagaattgatacgtatatattgagttaaaaatctttctcttggaagctgttatcctatgacacttacaatttaatttctctcttctttttaagccggagtatgagcaatatcttatcagctcacgatacatttatgaagcaatatcctaaagtattcctgcaccaaaaacccagacttcctaaacttttcaaacaggaggaacaaaggtaatgataccttcttttgaaagcaaggttgatgggtgtgtatgagtgtgcttgtgctcacacaagttgaactcaaaactgaaaatatttgaccagtttcagtcaaatatttagtgtggagggctagggagcagccaaggaaacagaaattagttggtaagggtaaattcaatttttgttcagcaaaaatacgtgtccactgctaaagatcatatttatttaaactttttatcaaagaattgttgccttttactaatgaacggcagtgtttatgaaagggattaaaatattctacagggtttcatgagaaacttcccaatggaaatgattagagtgtttgtgggtggaggatatttggaggtgtgtcatgtatcaaggtataaatcacaaagtcatggggcactgaaaggcatttgtgaagccttttttactgggctcctgcttctaggtggacctacatttagatgtgctttatgtatttttaaagtcaaagaatgagattacttaagggtgttgcggaaggtgtaactgccctctcagtaaaggatgaaggtagattgccagatcacattgtgatgcagctcctctcaaattgtccctggctccagtggaactgtaagtgtcttatatcagtgcagtaccagatctagaaaggcattttcacttcctggatatagttgtctttgttgttccttaagtatcttatagtggatatggaaacctcctactccatactattcaagtagagttgatctgttcacatccttggctaccccactgccatactccctaataacttctattgccatatctgtaagactgtattttgcttgtgtgtttgctagtcagtatttttatttctgacatttagcagagggactgacctgtaattgtgaatagtagatgtgtgttgccccatgggcaaactgcttactggctgtgtaagggagctgatcaagaatatgttttcatttatttatatcaatgatacaaatgtaaaaattcaaacaaaattattgtaacaaatatgtctccaggggttggaagatatcagcatgagagacatagatctatttcattatcctatacctttcttttctttatagccatagggcagtattatgtaaaacataccatattagttgactgggaaaaatctctgggagatggagttgctctgccttttcaagaacaattctgttaaattaataaaatcttttgaaaacagagattcaaatataactttttccaagactgtatctatcatgtagatcaaactacatccctagatgtacatacatctggaatgatcatacaatgcttatactgtgatttatcaagttaacatcactctaaaaatatctgataaaaatactttgtactttttgattccaagtatactcaatttctattctaatcttgttgattagaaagagacctgtaaatgtagctctgtctatagaataagggaccaagagcttttatggatagctgatatgatcatcttgccctcatatttattcattaatctaccagcagtggtctgcttctttagttaagacattaaactttgagaggacttcagggaggcacccagtggctgtcaacatacttggtaatgaaataccatcttcatatttttaagaaaagagacagatcccaaatgtgttttaacagtaaaactgtggtttaaatgtgaaaataaagagtggactgccaaatacacaagaactaggacgatacactatactaattaagatttgtttaagtgtctgaaaagccaataaaattagcttaagaatcaaggggaattttaagaatcacattttagaaatgttttgctgtagagctaacttcaccattaaatgatggcattgggactcagtttcctctgtatctctgcctcctctttgctgggttggtttcatcgtcacacatcatgtaataggtctgggaagaccacattcatttattttactgttcaggtgagaatggaggtgttctgaaacaggcccagcaggagattcactgaaatctctaaattatatcatatccctgtattgtcactgttgtgaatttgccaatcttgaaccacatgcccacctgaagagtggggaatattgttgacactatatgaagcacatgggataagattagaagagagaaagtggaagctcagaagaaaattaggggccgggcgtggtggctcacacctgtaatcccagcactttggtaggccaaggcgggcagatcacctgaagttgggagtttgagaccatcctggccaacatggtgaaaccctgcctctactaaaatacaaaaaattagccgggcatggtggtgggcacctgtaatcccagctacttgggaggctgaggcaggggaatcacttgaacccaggaggcggaggttgcagtgagccaagattgcgccactgcactccagcctggagacagagcatgactctatctaaaaaaaaaacaaaaacaaaaaaacaaaaaaaaaccccttaaactgaattaaatagaatttcctaaagtatattaagaaaattgtgaattttcttctaagcttagtatacatagttcccacattcagtgtgatatatctatagataccctgatgattgaaactcagcttatgtaaatccaagaaatttttaaaggaataaaactgatgaggaaactttcatgttagcagacatgaaatacctacactgttaacatttacactattacagttattgatcaacaatatttacctgttatcattgtcatatatttaacactgtaattcatttaacacaaatattatgtgacagctacaacagcaagtaaggcacctgcctggttgtgggcagctggtgatgccaggtcatttgataaatattgaaggaagacagtcatgttcaaggagagtaggagaaatgctacatagaaatgttaagtccatgtggagcaaggcacacagatgaaaataagcagaagacctggctgagacgttgagaaacaattctatatgggcaaaaattgaagaataggataagaagatgaagtattgcttgggactttgatcattatttaaaatttattttattcatggattgataagaaggtaaaattttggtatattcatatatgtaggaaatcaaatagaaaagaatctgtgttgttttaaaaagaacactcagtgttgacccagaagacttggttttgtgtttttgtttcactcaatagcagaaacatgactttgaagaaagaagtctgttaactcacactcaggttttactcagaaaagggcagacaatattaatcccctacttcagagttatgcattgaaaaaacttttaaattgtgctagttttcattattatcatgcactataaatggcaatgatgttttatgtacattataccatctgtcaagaaattgaccttttttcaaacagattaaacaaccgcaacaaaaagaggcaaacttcaccttatataaagtaccagtatgtttaaagggggctgtgaaatgaaatgatttccatattccaatggccagatgaaattaacaatgttgtgattatcatcataagaattctttttttttttttttttgtgctgagggcaggagtgcagtggcctgatctcggctcactgcaacctccgcctcccaggttcaagtgattctccagcctcagcctcctgggactacaggcacccgccactacgcccagctaatttttgtatttttagtagcgacgaggtttcaccatgttggctaggatggtctggatctcttgacctcgtgatctgcccgccttggcctctcaaagtgctgggattacaggcgtgagccactgcgcggggccaagaattctttttgatgatactgtacaataattgacttacctgttcccaataaacataatggtcattttttttaaaacaacaacaacaaaatgtgattgccattttgagccatcttaactcattacagaaagatgggccataatccagatttacatctatatcttatatttagaatacataattgtaaaggtactaatttaaacaaaatgctagtttttatgtaaatagggagcccttttgctttccacatattctatgcttattttagaactttctttttcacaaaaattataacttcactaacttttgatattttcatttactttttaatgacagtcttggaagtatcgtaaagctagatggtttcctgagaatagtgcagttaaagggaatttggtaaatagtttacattttttaaatgtaattgtaactttctacacttgaaaaattcctaaataaacattgcagtgtggttttttttttattatactttcagttctagggtacatgtgcacaacgtgcaggtttgttacatatgtatacatgtgccatgttggtgtgcaacattgcagtgatttttactcagaatatgtaaactgcagctcaatctgtttgcctttgaacatttactcaaatttatactctccaaactttattgtcagtactatgatgagaaatatttttaaaatctgagaaccctggcttaagatagaaagttatgatgcttgtagtttaaatacatagaagagaaacattctgccgtcaagaaatcttccgattttgtgttaaattggacagtataaccacccttttctatattgacatccaactgtttcttttattaattaatccaattacttaccaagtagctattatatagcaggcactgtgctagtgtagagtaagatgaatgtggtccttgctcctctagagtttatgagtcagatcttctcaagggagacagccttaagcaataatcctgctaataataatttaagcacgatttgtcttcatgaattcatctttcagtttttagatcggatcatgaattagtccaggcttttagttgtaatcgaaattggactcaaaggaacataagttcctctgaggaacattaaaaaaaagttgcctattgattcgcctaacctactggaggatgggaaaagccagccttagagaaaagggatacaagatctggagtgcttgtcggactctctacttctcatccctgctcatatttgtagattatcccaattccctcttggtgattgtgacctttctccgtgtggcagggaacatggttaccaggaactttgaacttgtaacacctgtaacactggagagaaaaaggaatttttttcaaccagaataatcctgaaaaaggattgagattggctgcccagtggcatagaacctgttagcaaaagaaatgggggagggggagcatcctgcacaaagaagatagccactgtaaacaatgagtgctttcctaggtgtaagataaattaatacatatagtcacagtaaaattgctacattgtttacttcaatacatttaatatctaccctttaagcaataagaaaagacatagatttttaatcaatgtgtgtttaggtcagtttatgtcaggagtgaaaaagaaatgaagtggagtcattgtctggggtaatacccaaggtttgttccatgaccacggaaaactaggacgtggacacaacagagtgaggttaagagcagaggtttaatagacaaaagaaagggaaaagttctctcctgcagagagacggggtcccaagtgggtcttctggtccccagtgaagtgcaggaggttttatagatgagcttgaggaggtggtgtttgatttacacagggcacaaaaaattggtcggatcaggtatgctatttacataacacgaagaactggttaggattagttgtgctgtttgcatatcccacgaagaagctggctacctcaccctaatcttttattatgcaaaaggattctctacctcaccatgttgcctgcttttctactgtacatgtggtgacaaagaaaagggaagatggagcctccatgttgaacatacctggtttccaggtagcccttttctattggcacagctgttggcattcacccatgcaagcttttagcttgcttatctatgtttgcagctggattactttcaggctgctctttgttagaaaagaaattatttgggggctgctttttgttaaaaggcaagccttgctgaggactccttcaccctcactatctgcctaaataatttctttttagctcccatatcaaaagtttaaggaaatgttagtaattgaggaaacaaatagtaagcatccaaagaattatggaaacctttgttaaaaatgtatttattcaaaatgtggctttttattgatacatagtagatgtatgtatttttggacatgtgatattttgataaatttatattgtgtataataatcaaatcatggtagttgaaatatttattaccttaaacatttatctatgctgggaacatttgaattattctctactagctattttgaaatatacagtagattattgcttactgtagtcacaaagaaagaagtgatattatccttgttcataaatgacatgagcttatatttagaaaaccttaaagattccatcaaaaactgttagaaatgataaaataattcaataaaattgcaggatacaagagcaacgtaaaaaatcagtagcatttatatatgccaacagcaaacaatctgaaaaagaaatcaagaaagcaatcccatttacaatagacacaaaaattgtaaaatgcctaggaaaatatttaaccaaagaagttaaagatctctactaggaaaactataaattttaatgctgatgaaaaaaattaaagaggacacaaaaaagtaagaagatattccatgccccggactgcaagaataatattattaaaatgtcagtattacgcaaaatgtgacatttttatgggggtggaaattgaagtatttacaaagaaggctgcttacttgttataattttatttgacttttataaaaatgttatcagattttgaccattttagttccagaaggggttagtcagcattaaaatatcaaaaaaattttaaaaaattcagattaactttaacaatgtatagtatttgtactagattggtagatattaggcaaaatgtttatcaatgaggggtacatttttctaaagggtgcagaccaaaaataatgtggcagaagctaaggggaaaccaatgatgtatttgaattattagctataatacttcttccaatatgcagtcatgcactgcataacaacatttcagccaacagtggatcacatataccatggtggtcccataaaattaaaatggggctgaaaaattacctatcactcagggacttcatagctgcctgtaatgtcatactttaacatattacttatgtttttatgatgatgtcaatgtaaacaaatctattgtgctgccagttatataaaaatatagcacacacaattatgtatagtacataatacttgataatgatgactaaagactatattatttatgtatttactataacttttattgttattttagagtgtatttattctatttatattttaaaaaaaaggttaattgtaaaacaacctcagacagtcccttcaggagggattccagaagaaggcattgttatcataggaaatgacagctctgtgtgtgttattgtccctgaagaccttccagggggacaagacatgggtgtggaagacagtgatatcaatgatcctgaccctgtataggcctaggctaatgtttgtaattgtgtatgtgtaacaacaacaaaaagagcttaaaaagtaaaaataaaaataaaaaattttaaaaatagaaaaatgcttataggataaagatagaaacaaagagcatatttttgtacagctgtacaatgtgtgttttaagctaagtgtttttgcaagagtaaagacattaaacacaatgaaaaatcttataaagtcaaaatgttacaataagcaaagggtaatttgttattgaagaaagaaaaatattttacaaataaatctagtgtagcctaagtgtacagtgtttttaaattctgtattcacatacagtaatgtcctactcactcactgactcacccagagcaacttccactactgcaggctccatttaagggaagtgccctttacagatataccattttacattgttaatcctgtattttaatttagctctaccttttttgtgtttagatatgcttagatacgtaaatacttaccattgttatcgggggaacctgcccccgataattcttcattatttcacataggttattttctattttccctaagtgttggctggtctgagaaataaagggaaaaagcacaaaagagagaaattttaaagctgggtgtctgggggagacatcacatgtcggcgggttctgtgatgccccctgagccataaaacaagcaagtttttattagcaattttcaaaggggagggaatgcacaaatagggtgttgttcacagagatcacatgcttcaagggcaacaaaagatcacaaggcagaaggtcagagcgaaactagcatcactaatgaagtagacttgtcccgctgtgcacgcattgtcagggttcaagagcagagaacctgtctgagtagaattcgccaggctggaatttcctaatcctagcaagcgtgggggtgctgcaggagactagggtgtgtttcatccctatctacatctgcataaggcagaacctcccagggcagccattttagaggccccgccctgggaatgcattcttttcccagggttgttaattattaatattccttactggggaaataattcagtgatatttctcttacccgttttcagtcataagagaaatatggctctgtcccacccagcccacaggcagccagactttaagattatttcccttgttccctgaaaatcgctgttatcctgttcttaaggtgcccagatttgttattgttcaaacacacatgctttacaatttgttcagttaacgcaatcatcacagggtcctgaggcgacatacatcctcctcagtttatgcagatgacaggattaagagattaaaataaagacagacataggaaatcacaagagtattgattggggaagtgatgaatgtccatgaaatcttcacaatttatgttcttctgccatggcttcagccagtccctccgttcagggtccctgacttcccgcaacacattgtgttgcaattgcttataatatttggtacagtaacatgctgtacaggtttgtcgcctagaagccataggctataccatattagcttaggtgtatagcaggctataccatttatgtttgtgtaagcacgctctatgatgtttacccaatgacagaatttccaaatgatgcatttctcagaaagtatccctatcattagtcaacatatgactgtattcagattactcaattaatcaaaatgaaagttggttaattttgaagaaaatgttaaattaaaagtcagatatataatattaagtgaagaagtttctttttgtaaagagttaaaagcaaaaatgaaaaaaatcttgaatgatatctacctaatctacacttcccttaagctatatacttaacaaaatcaatattattttatctaaagtgcactctcagaaagaaaaaagagcagaatagttgattaatatgaattgaatgcttgagcaaatgtatcaaatggaatagtaaagaagaaacatgcttaactcaaaatggcacatgtctagcatagaaaaaagattgtaattataaccgcccaatgggttcttcttgcctgttgcccagatagagccaatttatcaaggcagggaaattgcagtagagagtttaatacacgcagagccacctgaacagggaaccacagttgtattattactcaaatcagtttctcagagaatttgggggctagggtttctcaaaggtagtttgggggaagggttgtgggtggttaggaaatgagtgcttgctactgattgattgtggatgcaaccataggaatgtgggaaatggtcctcctgtgtgctgagtagcttctgggtggggccacaggagcagttggtgggtcctggtagagccataggtcactggacatgcaaaaagcctgaaaagacatatcaaaaggccaattttagattctacaatagtgatgttaccttcaggtataattggagaagttgcacgtcttgtgacctccagcatagtggctgggaattgcttatgtctacaccttagctgaattcagtctcctctatcctcctaggtttgtggtctcccattagctttacaaatgcagttgagttttggggaagggctattatcatttaaactataaactaaatatctcccaaagttagctcggcccatgcccaggaacaattaagggcagcttgaaggccaaaggcaagatgagtgttgcccagatcaaacttccttcagtgccataattttctgttataatttttgcaatggtggtttcataatgatatattcatatacaattaactttccagacaagatgtgtaagaactctttggaaattcagatgagtactggaatccagctaataattaagagtgcattagagtgaatgtgcattgccttgacatatagtgtctattttgccactcagtaactatatgactttggagaagtcaatctatctgggcattagttaccttatatcaaaaataaaatgctcgggtagatgacagtcaattctccttttagctctattaatctaaggttccattttctagttgatgttacagatactgtagggagagaaatatatgtaatgaagataatatttttgtattaacttttgatgtatcttcccttatgagtatttccttccctgtatcccatgtgccatcatggtctcagagaaaagagcaggaaaaatattactttaagtaggaggaagatataaaatggaggtgttactggtggcaaatctgttcgggtctgcagcaacctcaatgcttgtctcctcaggagagagaatttgactaaggggcatgaggcagaaggagagactgaggcaagttttagagcaggagtgaaagtgtattaaaaagtttcagagcaggaatgaaaagacgtaaagtacacctggaagagggccaagtgggcaacaggagagatcaagtgcactgtttgacctttgacttggggttttatacgctggcatacttctggggtcttgcattccttctcccctggttcttcccttggggtgggctgtctgcatccacactggcctgctagcacttgggaggtgagcatgcacagtgtgtttactagagttgtatgcgtgctctcttgaggcattcttcccttaccacttgagtgtccctagaaagtcatatacctgttaaactctgccattttacctcattatgtgtacgtgtaagtctacttcacccaattcctgggatcttattggaaaactgctgattactagtttcaggtttttttctatcttttgggagcctgcctttctctggtgctggctgcaacattattattttattttttattttttttttgaaatagaatctcactctgtcacccaagctggagtgcagtggtgcaaacttggctcactgcaacctctgtcttctgggttcaagccattctcctgcctcatcctcctgagtagctgggattacaggtacccaccaccatgcccagctaactttttttttttttttttgagacaagatctcactctgtcacccagactggagtgcagtggcacaatcttggctcactgcaccctccacctcctgggttctagtgattctcatgccccagcctgtcaagtagctgggactacaggcaagcaccaccgtgcccagctaatttatgtattttttagtagagatggggtttcaccatgttggccaggctggtcttggtctcttgacattgtgatccagcctggtgacagagcgagactctgtctcaaaaaagaaaaaaaaagaatatctagatagttattgaggaagctgcaccttctaggacaatgataatcaacttgaactacatattagaatcaccttaggagttttgaaaaatactaatgccagatctgtgtccactgacattatgtaaattggagtccttggcttcaggctaggaccttagtaattaaaaaataacttttaggtgattattgaaaattactgctgtacaggaagacctaaattgggctcaacagaacattcaacatgaagagagaatagtacagaactggtggagacagatgtcttgtgatctacctcgagttagtgccattagatccacttggtctgtgtctagcttgcactgagggggtctagaatttcccatgaacactggtaagggtagagtgagttgccagtaggactgatgggtggtaggactctggggaggggaagaccaagctgctgagtcaggaatctgatgacgtgaggagaagagagttaagagtggatgcagaagcagaaaaatccattcattcctaagtagataccaatccagagccaacctgctggccactctgcaacaggaacatgatgatgatcagctgatagcttcctctctccaactacaatcatgtaagcaatccagccctcccccaacacacacccaaaccaagtccagaaaaagatatgaaatttacagaaaattgttaaaacagcctttatttacctgacagaaacaaagttattctaaattatactttttcaaattagtgagactgagataccataaaatggtattggaggaagaggatctgtgagctcatgagaaagttttagtttctttatagaaagtaaactattttctttgtacatcttagcatttaagtaaattttcaataccactaatctatttagctattaaaatacttatttaaactatatccttttaaaggggaatagagtaaaatgccttttaaatatgagaagctgcagaggatactgtctctttaaaacatgcaatcctaattgcccacctctcaggatgcataatggttgtagcatagttagcacggattctgtcatgacttaaaaaaaaatttgtaaacatgctttcttaaagatgcatcatacactcttcttttagtgaatggaagtgtttgacagaaaaacacctgtgtaagcaaactttgagaatatgttattagaacatgtttctttcctcactggttcatattacacaggtttacatctgctgctacaaaaggtaagtgtaagcatgctgatatgatttggttctgtccccacccaagtctcatcctgaattgtagctcccacaattcccatgtgttgtggggaggacctggtgggagattattgaatcatgggagccgtttcccccatactgttctcatggtaatgaataagtctcatgagatctgatggttttataaggggtttccccttctgcttggctctaattctgtcttctgtgctgccacataagacatgccttttgccttctgccatgattgtgaggcctccccagccagatggaactgtgagtccatcaaatctctttttatttataaattacccagtcttgggtatgtctttatctgcagtgtgaaaacaaactaatacacatgctatctttctttaaaaaaaaaaaaaaaaagatttagggagtaaaagtgcaattttgtgtaggcatcacccacatagtgtacactgtacccattacatagtttctttttcctagccccgcctttctgagtctccaatgactattatttcactctatgttcatgtgaacacattatttagcttctacttgtaagaacatgtggtatttgattttctgtttctgaaaatatcatgcttttttttttaaaaaaaaagagaaaggcaattggaactttaattttgcccctataaaaatgaaatgtcatgtatcaacaagactgaaaaataaacaatcctctcatgccctcagcagttaaccctaactatagaagacaaaacgatgtaaacaaagaaatacacataggattcattcatattgggatccagaaatacatattgtggatgacagtggcatacacactccttttggtgttaagaggaaacctttagacaaattaaatatgtaacagtttatttgagcaaagaatgattcatgaatcaggcagtactcaaaactagaagaggtttggagagccccaaccagccatgtgagcagtgagttcttataggccaaacaagggagcaaagtgtagaaattacctgattgaccagtaaggtatctgccttatttgcaaatggtgtgataaaacatctgcctttatagcacgattcaatcagttgactccctgtgattggctgaagcttagctgtttgtgattggctaaaatccagctgtttgttacaaaacgtatactcctgagttaggtttctgtttgtttacacacaaagttaagttgtggtttgttgattaggaactcaaagtactgagacagcctcaggctagtggcctcctgcttgtttaatttaacaatgggaatttattattaaaaggtaattattaactatttagaggtagaattactaggcagtcaatgacagaaagctgactttgctgtcaaagtgactttcaataaacttcagattagtgtttttcaaactttaatatgtgcacagatctcctggggagcttattaaaatgcagattccaattcagagggtcttgagtgtggcctgagattctgtgtttctaacaagctaccagctgatcctaatgatactggttcatggaccacaatttgaacagcaagtttactgtttgatatgtttctttttctttcagaatgtgaaaaaaaaaagtcaccaaactgtaacttttctattgggaaaagtttctactgggagaatttagcccacattttaaagcattaattcattcatctaagggcttatttcaatgagataaactacaaagctgtgtatgatctttggtcataatatacttgatttattaaatttagcaaccaatcgcatgttgcacttaatgtgcatagcatgtctgtttgaaatttttttggtatattttaatttaggatcttttaaagaagtccaaccagtagttattatcttaaaaagttccattttaattaggtactaaatcagataagaaaaagagagaaagaggtagcttgctaagtttaggagtttccaggcttgtaacttaaccaggtaatggtagtattttgtaaaatcattttctcttagtttgtgttatataacttacaataatttggaaggcagctatggccaccactataccaccaacacagaacttaataatttgaacagaggagaacaaaagaattttggcaatgtgcatattgtatgctccctctcccactagccccagaactccactggctactctctaatatgccaaaggcagcctgacccaaggaagtctgttgggaatgtttctcatgggctcagaagtctgtatgctcagtcacccaaattgccagtcataccaaaagctgtcaaagtacgttttaggcaaaaaattgatacataagtttggattttagattctaaagaggctaggacatcccaattgctcgaattaaagaattttactgagaattttacttctggatctaaaagcagtaaacatgtagctttgatctgggttaaaatgatgaagggcttctctgtaatactcatttttttttcccaaacacattttaagacaatcattggtatagtgtatgcatagtctagatggcctataaattctctctaaatgtgtgagagcagaaaatgttcaaaagtaaagatgaatatttggagatgaagcaactgaaaacctagagcaaatggattctgatagacttaaaaaaaatctctgcaaaattgcattttgaacttgtgagtcccttttgagtttttgcacttaatttctttctctagcatagctgaaattacccatatgatacagctacatctaagtgtacttatttcatgctagtgtggatctggcctcaggataaataataaatgtttgaaccataggctctttgaaaatatgtatttaacattagaataaatgaaattattcttgttatgactataaaacccatattttctctgagctccaaggtctgttgaatgagatgctccttgtgtttttttttaagtcagccctatagttattgttttaccaatttattctaaaaaataaaaataaaacttacactatctgaaaagaaacctcacaataatactgtattagtctgttctcacactgctaataaagacacaactgagacttggtaatttttaaagcaaagagttttcattgactcacagttccacatggctgaggaggcctcatgatcatggtggaagatcaagggacatcttacattgtgggaggcaagacagaatgagagcaaagtaaaaggggaaatgctttataaaaccatcagatctcctgacacttattcactaccacaagaacagtatgggggaaactacctccatgattcaattatctcccaccaggtctctcctacaacacatgggaattatgggaactacaattcaagatgagagttgggtggggattcagccaaactatgtcaaataacctgtcatttgtttattcagtaagacaatatacactgagcaccaactgtgtgctaagtgcaagtcagagagggcctctgtgctcagagcttggtggtgctgacagggtctgagtaagaggtggtaagtgcagtgtagggggtgtcagaggaagacttcagggcaggggtagttgcattgagagtgcttacattgagggcagatggtgtactggaagatcagagaagcagaggaggctttcttgaggaaggaatgtttaagttgaaggataagagttgtccagaagaagagaaagattatctgaggcaaaaagaaccatatctgataattcttcatgttgttgattatctaaatgctgtcaaagccaccttagctgatactctaattgcccaagttggtagttgtcaccagaaacttgttgaaaaaatttttttcaaaacctttaaatgatctcccccatgggtgtcaagatgggagtgatggcttgaggtgggagaggagacaaaaaggaagaaaggaagagaaagagaagaaagagaaataaaaaaggcaaggcgagggagaagtggacatgccaggtcataggagcaatatttggaccttttggaagttttatgaaggaaggaagaagaaagtttgtattaatagaaatctaacattgtctctgccatgctttggtcttgtcctttgtaccccaaattaacccctctaccatgacataaaaaggaaagcctggatggcttggggtattattgtagccaagtgatgacaatttgtacaaattggctacaggcataagatttgcttgcagtaaagtggaaagttacaagaaagtttcaagtctgagttaaaaaaaaatccacttatgatgataactgccactgagtaatggtagattatgctaaaaggaaggtactttcgttttatgcttccttcctgattgctttggtttgaagcatctgggtataggtgctgagaaggggtgaattgctctgcctggtagagatgttctaatttagagtcacggagcaaccaggagtgaagaaattcagagaaaaagaggacaggaaggaagcaagaggagccaggaaatgattgaagaaaggtatgcactaagtaaggagaaactacaatgttggggatgggggtgagaacattttaaaaaagaactgttaatggatttcaagtatgttgtaatatgtgatactgttaccagaaggagggccttgagagtgagttctccaggtccttggcgtttttaacaaagaattggacaaaacacacaaataaggtaacaaaggaacaaaacagcgaaggcagtgatttaataaagcgagaaagcactccacagggtgggagtggacccgagcaggcggctcaagggcccagttacaaagttttctaagtttgaagtactccttttgaagtccctatcagttatccttgtctcgatgaaggtcttgtctgtggctaattaaaggctgaggtgaattggagtcctatgcagatgaagggatggtccccgcttggcccacagccattccagggcaccttccctttctatctgagacatggtggaagggagggttgtagggagagtagcctttgatccttgctacttgggcatggggagatacggtttttccttttagtttaacttttggaagctggtgttaattggtcttagggtccctgcccctagacccaggtgttttccttttgacccagctttgggaaatcagcacagattggactcagattccccgcccccagcctttggtgttttctcttttaagaagtcagcacaaattggccttagattccttgcctccagaccccattctcctgcctcaatgcaacatctcttcaggatatcctcagtatttggtaaattctaatttcaagtgctctgcatggttgctttcatttagttcagttttgttgagaaaatattaggaaaagttggattcatttctgggtaaacaagccatagaataaagagagcatttaaagaagaatcatagaaggacaggtgacatcagaacagaatattctggggaactgctgaaagggagagctttacactttcatggatttccatgggactgtatcaagaccctaagggaccaatgagtcccagctggcatgaccatatgcaatgaagggagaaaagcccatctttgatttaaaagtagtaagttccattcaattcaattcaaaatgatatcgttcaaagtttgtaaatttcaggttttgttactattggtggcaggaaatgtacctccctatgtccttaaattggagcttctattgtcccaattagatgccccattcattacttagcactatgggactaaaatctacttgagaagtttgcaatgaaaggaaaaagaaattctgaaaattcacaggccatattttctgtaagtcttgcttgagtgaccatatacctgaatggctagaacgatgttttttcattatttctcaacaattagtaataattgtaggtagagagcatttgaaccaaggcaaattgtctacagaatgtggaaatggggttgaaaaaggagctagatgagagtcatcaagatgagggtgtaggaactccacgaatagctaatttaggaatgctaaacaaaatcaaagatccgttaaaattagataatgtagatttgtaattatccaggtgtgtcactaattcagcaatgttctgtgggtggaaaaagtagagtggttaaagtggaaaatggaaattattcattcctgggagctgagacagtgaagacaatgaatatttttttgcctgacaggagttcaacaaatgtttctgaattgaattataaatagaaggaatttaggctataagtgaaaatggaacatgatatttgatgattattttataaatacttattaatatattgctatatattaaagcttgtcttaagattatcccaactctttaatttgcttctttaatttgaatttgtacttaggaagtaaatctgtatcgtaataatcatctctgaacaagttgactttcttgcatgtttctatagcttgtcatatattctggaaaatgtattgctactttagcctaaagaatacatgtaagtccaactgttgatttttagctgtatatttttctattgcatttttggaaatgtaaagagaagaccttgagtttggcacagacattaatttagtagaaaccggggaaatattgcttacctctctctaaccttaaaatattctttcttatattataagagatgacaggatttcaatattgactgtcaagagtttatgatggaacttgtcttggactcctcaattttaaccttggatgtgtttgggaatgtgtgggacaaagtcagcactcttggttagcaaaagacaaagcctggaatttgccaacttatatcctggagcgagaatttacccatagttatttccctcgtttggtactagtgataattaagctaagcttaacagatggagttaacttagtgtacttagtgtgactgaatttaattagtatttttatgagtgaggctcacttcagtttttatttttaaaaatgatggaagaatcttacagcaaacatctttagaaagagtctgtatattactctggttctaattactacctagtaaaatatatacgggcttaccaaaaagtgtgtgtgtgtgtgtgtgtgtgtgtgtgtgtgtgtgtgtgtgtccctgtctgtatgtgatggtgggattgggggtaaaggcagtaaagaaagattttgggaactgataaaggaaaaaagtttgtaagagctataatacaggaatatatgcactttgggaggccaaggtgggtggatcactcgaggtcatgagtttgtgatcagccttgctaacatggtgaaacaccctctctactgaaaaaaataccaaaaaaaaaaaaaaaaaagaattagccaggtgtggtagagggcacctgtaatcctgtgtctggagttggttcctgctggtgggttcgtagtctcgctgacttcaagaatggagccacggaacttggcagtgagtgttacagctcttaaagatggcaggaacccaaagagggagtggtagcaaggtttattgcgaagagtgaaaggacaaagcttccacagggtaaaaggaacccaagttgtttgctgctgctggctggggtgaccagcttttattcccttattgtcccctcccatgttccatttctgtcctatcagagtgcgcttttttcaatcctccccatgattggctacttttagaatcctgctgattggtgagttttacagagcgctgattggtgcattttacaatcctctcataagacaggaaagttctccaagtccccacttgacccaggaagtccagctggcctcacctctcaatctcccctctcaactgctgttgagaactgggcaatgactgctctagctacttcctgctggataggggtgaagaaggggccctgcagttgtagtgtcctccagaggggaactctttagaccagtcaaagggccagtgggtcggtccaggtgtcctcagtagaagttttgagttgagctcatttggggttccagttgtaagaccatctgtagcttgatggccttgatcctgggggaaacaaatttgacaaggaggttaaaaatacagggcctaaaggcaagtaataccaagatggctgtcatgggacctagaaaggggagacgccatgtcacccaactccagaggttggtgtcagagtttgaaaggcattgtctgatttcagaagccttttcctgtaaacaccaggtgggtctcatactatccctgactggttggtgtaaaaacaacactctttcccctaagaaggtgcagagtactcccctctcagcagtgaggaggtccaggccccagcagtcttggagagtcaccgctgccaaagactccacctgggattgcagagtaaggacagaccctgtcatttcccataaactgtatgagaaatcctttgagagtgtgtggtagtaggataatgaagtagataaactggctattctggcttctgtagcagtagccattcctaactgtgtaagtaggggtattagttttatggccctctactgatagacttgagctttgaggggcactgatagggtctgatttcctggggcaatgtcaatgttgggacttaggaagactaaggttcaggtgcctgtgcagttggtggggaggaagatataggctgaagttccacataagaatatgccttggctgggtagacagaactggttgtatatgttaaagaggtgtgtgagtttgttgttttcattttcccatactcctagagtacttgccaaggtagctctggtgagcagctggaaaggggtgttgggagcaaactgagtggctctgtattctattttcccattggagaaaaaaccattttgtatttactaggaaccattcaagagagtaactgaaagaggggataagaaggcattcattagtgggggaggcgctgctgcagggggtccaggggtgaatggtcatgcagggagtatgcttgccattacaaaacccagactgtttgttaaacagggagaaggtgatgatttttgggggccctgagaagcagacaagctgtttgagtggacctgtttaggtgactctgaagttactatgatcagttggggcttgaagttgtagggtgtaattacattgatgggatagtaggtgccccaggggcaggcctggtaacaggttgtgttggatgcataaaggggcttggaaagttaagacagtaaacatggttgatgtgattaggattttcgtcctggcaggagctacagtatatagtcctactgcaaagagtatggttagtatactgcttaataatgtaatgatacaataaaatgattccatcaaagggacaaggagaggtgttaaagattacataggttttcacttatattttttaagtaggaaggggtttttcctcaggataagctgtaggagccttttgagtctgggatatttccttctgaaataggagacgtaagtcctccaataattcacaggtgtatcgaggctggtctggctgattttgggactcctgagctgatggtcttgcaggttcctcagggggtgtccaaagtttaactcgggtgtggtgaatccaagattccactcttgccaccttaactgcagtggaagtagagaggattactgagtatggtccttcccacaagtaatccatagatggggaggtagagggaagggacttgaccaatactagatctcctggttggaacagctctgttcccttgtctctgtgacatccttcatttagggttttaaggttttgttgatatcttgccaaagaagttatatccttgaccaagttggccgtttcctgatcaagtaggaagtcatttgtgagaaaatgtcatccatacagcatttcatatggacttacccccattttgtgaagagaatttcggattctcgacaaggccatgggcaagagaataggacatgggagatgagtttcttgtgttagtttccttaagtgcctcttgagtatttcatttacctccttgaccttccctgaggattgtggtctccaggcacagtgaaggttatattgtatccctagcgccctggaaattccctgagttaccatgactttaaaagccagaccattgtcactttgtaagctttgggggagcccaaatctaggaattatttcatgaattaggactttaactacttcctgagccttctctgtttgcaggcttctatccaatttgtgaaggtatcaacgcagaccaacaagtattgaaatccccttgacttaggcatatgggtgaagtctcactgccagttgtctccgggatagtgccctattttttgttcccctagaggggccttatgagggaccaagggattattgttttggcacacatcacaggctttgacaacttgtcagatggtctgtaggagatttggccctgtaaatagggatttggccatttgatgagtgttctcaatacccatatgaaaagtttggtggagagtcttaagtattttccactggctggctttgggtatgagtaccttactctcttctgtcattaaccaccctgaggggagaaaactatccccctgtgaaagtccccattctttttcagtcgggaaatactggggcttaatctcttggagagggttgttccataccaagggtccttccataggtatttctaatgggaagttctgcctggcagcaattttggcgtcagcgtctgcccaatggttttcttctgccttttctccttcaccattttgatggctttggcagtgtaagactgccacctctttgggtttttgcactgcatgcaataactccatgatttctttgtagtatttaatgggggttccctcagaggtaaggaactccctttctttccatattgtaccatgggcatgtaggattagagaagcatacttgctatctgtagacacatttattcttttttcccttctcagttctaaggttcaggtaagcaccagtagttctgctaactgggcgctggtccctgggggaagaggcttactttcaagtactgttacatcactaactatggcataacctgcccttcatatcccactctccacaaatgaacttccattggtatataggttaaggtcaggattagctaaagggacttctaagagattctctcaggcagcataagtctgggcaacagtttgttggtagtcatgctcgattggttccccatcctctgggagaaaaatagcagggttgaaggctgcacacatgcgaatttgaagcatcagtccctcaaggagtagtgcttggtatctaagcaggcagttgtctgatagtcataaatttcctttggcaactagtatgccatttacatcatgagtagtctagatggtgagatcctttccttgtattattttgatagcctttgatactaagatggccattcctgcaactatccgtaaacagtgaggccagccgtttgctactacatcaatttccttacttaggtatgcaactggctgtgaggttgtcacacaagtctgagtaaggactccaagagctattcccactctctctgtgacatataaagagaagttttgtcctgtgggaaggcttaaggctggagcttgtactagggcctactttaaggttttgaaggctgtttccatctctggttcccattctcctagatgagtatttgccctctgggtctccttgattagagtatagagtggcctggccatctcgctgtatccagggatccatagttggcaaaagccagtgatcccaaagaacccccgcaactgttttaatgtcttacagcaaggacaagccagtataggctgtatttgttctttgctgaggtctctgcttcctctggctaagattaggcctagatatttgacttgttgtaggcagagctgggtgtttaatttagatgccttgtacccttgattagctagaaaggtcaagagatctagagtagcctgctggcaggaggcttccgaactgggagccaaaagtaattcatccacatactgaaggaccagagtgcctggacttgagaaatggcctagatcttgggccagtgcatgaccaaacagatgagggctatccctaaatccttgggacaagactgtccacataagttgggacatgtggtctgtgggatcctcaaaggcaaagagaaactgggagtcagagtgcagaggaatgcagaagaaggcatccttgaggtccagaacagtgaaccattctgcttcctctggtatttgagagagcggggtatagaggttggttacagctggatatagcggaattactccctcattgatgagtctaagattttgcactagtctccattgactgttcagtttttgttctcctagaattggggtgttgcagggactcctgcattttcttactaagccttgaacttttaaatgtttaacaatatcctgtaatcctttacaaacttcagggcttaggggatattgcctttgtaaggaaaagcggtggggtcttttagtctgatttggattgggtgggcattttttgcccttctgaattgtccttccaagtcctagacttcagggttgtttccctcctcaagtaggggacaacaaatgggtaacttattccccatattcatgtagataatagctccagctttggctaatatgtccctccctaataagggtgtgggactttcaggcataacaagaaaggcatgtgaaaagagcaaagtctccttacaactgaggaggtgggagaaatacctggttacaggctgtcccgggattcctcagatggtaatggaccttgaggacaaggtccagggcaggagattaacactgataaggccacgccagtgtccaggaagaagtcaatttcctggccctcagtggttaaacttacctggggctcagtgagggtgatgacatgagctggcacttgccctgaggaccctcagtcctgttgttggatcatctggttgggggcttctggcccagagaacctttgtcctcttgggctgtgcaccttccagtgattgcctcggcatagtggacatgggcaagggggtggcttatttctcattgcacatttttttttaagtgtccttgcaagccacactgataacaagccctactaggtgattggcctactccgttttctgtcttttctgaaccacaaaggtttgtttgtctgagggccatgactaaggctgtggcctttctcttatcttgcttttccttttcagcctgttccttcctctttgtccctattatagaacaccaaggttgccaggtttaataatgcctccaaattttgttcagggcccaggactagctttcggaggtttctcctggtacctgtggctgattcggtaataagcttatcttttaggatcaattgaccctcaagggagtcaggttacaggggagtatattttcttaaggcctcccctagctgcttgaggaaagcagtaagattttcttcctttccctgagttatggtggacatcattgaataattcatgggctttttactaattctacttagtccttctagaacacaggtcaacagatgtttgagactccagtctccatgatctgagtctaggtcccaatggggatcaatactggggacagcttgctgaccagtagggagtttgtccctttctttggctgtcattctgtcatttacttaagataccaggtatctccaaagtctcgggctgcagctaaagccacattcttttcattaaaggccagggtttgatctaataatagcatgacacctctccaagtgaggtcgaaggtttgccctagaccctgtaggacatctatatccctatcaggattatctgaaaacttccccaggtctaccttgatctgctttaagtcagagagggagaaagggacacgtatccatgttgggccaaattcccctccccctacagcttgaaggggacataaccgatagcccagggggttttttggtcccttggagatttctttgcttgtctccttctgggtgggggagattagaggaggcttatcactaacaggaaggggagctgtagggaggctaggatatgaaggtaaactgagaggtcctcctgtgggatgtagattgcaaactttgcatagttgtggattatccttcaatgaaaggaaagcttggacataaggtatttcactccatttgccttccctcttacagaaaaggtcaagctgcaggaaagctgtaatttatacttcccttaggtggccattttttttccatcagagagagaatattggggccaggccatagtgcagaaaaaaaataagcagcttctttttcagggcttgagggtcaaattgttcccaatggattcatttcaagggtgagcttcttgatgcctgagtgtttcccatctgaaagaaaaaaaactgcctatggttttgttctgttttttttttcttccccgcccaataacctgcaatggtccctggaccctgctgtttggaatagttgcgctcactgaagcagcagcggaaacacttgttttcctcctagatcacaaagaggaccaaggaaggtcgtatttagtggcccttaccgacacattctcgaaaacctgcacccttgcctttcctcttagaccacaaagaggacggagaaaggtcggagtggagggccataccctgagggagggaagggatctccagcattggaagagtgatgccttttgtcctcacttcttatcatatggataggaaggatataccccccaattttggagtctataatttctgaggctctccatatcctagcttcgggaataaccttttactcttaagcatctcttggagaagtcttacttatataagactggtcatagtagccaagtttgtatacaaaacaaaaaaccgaacaaacttaacaaaaatccaattcactacagactagaaaaatgaaaaaacaaaacacacaaactccccccaaagtctttgtggtacatacatataatgaaatctcataaagcagtaaaatgaatgaattagtcattaaatctcatgtacacaatgttgaatacaacaagaaaagcaagttacagaatccataagaatcacttcatttctataaagtttaaaatataaaaaactaaaatggtctttgtaaatgaatacatatatctttgataaatctgtaatgaaaaccaagagaatactagcaacaaaattcaggataatggttacttatcttggaatgagggacatgtcacctagagaaatagttgtacagtagctggtaaggttccatttttaaaaacctgggtgggtacattaagattcatttttgttactctttaacttgcaatatattatgaatattcttttttatttgtttaataattaatataaacaataccaaaaaccttaaaatgtcaacatcagagaaaggaaaaattgcctttttaattactagttctatagtgtaacaatccaattgagtacattattttatgtatctctattatttatctggaataaaaattaatccataaataattggatgttatgccaaaatgcatgaacagattcatagtctattcatatattgtacagtggctacttgataggataaaaacatttttaaacaaaaatttagtatctatagaagtttattttacaggagaatgcctgataccttctccctggaatattctttgtctagctccttttcatttttttatgtctcagcttaaatccttctgtccctgacatataacatcttttcctggcaagcaaagtaggtcccccatttttatattgtaatggtacctatgattatttttcacaacacatataaattttcatattatttttaacagctttaaattacatatttatggaactgattattctatcagtgccttcgtgcattcatatgtaaggaacataacgacagaagtatggctgatttttgtatattgaacttttataccaattttattgtcagttataatatctgtggattcttttggatattccatatataagatcacgtcatctgcaaaaaataacagctttacttgtcctttccaattcttacattttgtagttattttaattttaatgcttaggaccttcactagaatgttgaatcaattaaagcaatatccatgacgtttctgattccaggggcaaagttttcaaaatttcaccttcagtataatatttgctgtattttgtgtaaataattttgtcatattaagtttcatttctctttctagtttgctaacagtttgtattacaaatagatattgaaccatatgaggtgtttttttagatacccattattttttccttacgtattttgttaatgggttaaataacaatcctggaatagtattcctgatatattcccaaatagcgtaggctttgttatcttctaaaattatccctggatttagtgttaatattttgtttagaaattttgcatctataatcagtgacactggcttgtaatcttcctttctggtaatttccttacctgctattgatatcaaggctaggctggcctcataaaacttgctggaaactacatatgacttttgtatttttctggaagcatttgggtttgtttgtttgtttatttatttatttatttatttatttatttattttgagacagagtcttgctttgttgcccaggctggagtgcaatggcgtgatctcagctcactgcaagctccacctcctgggttcacaccactcacctgcctcagtgtcccgagtagctgggactacaggcacccaccaccatgcctggctaatttttttgtatttttagtagagacagggtttcactgtgttagctaggatggtctcgatctcctgacctcgtaatccacctgcctggtcctcccaaagtgctgggattacaggcatgagccgacatgcctggctgggtttatttattaagagtttgttagaattcaccaataggaccattttgacaaggagttttctttgtaggaaggttcttagttgtattctttaaaatatttgaacaattaaaatgttatatttctacttgtgtcagtttggtaatttgtagttttgtaagtatttgttcatctaaattttcaaatttattggcatgaagttttcataatataatctttctatctttttctatctgtgggatctgtgttgaagtcttcttttccatttctgatgtaatttatgtctgccttttctgtttttgttctcaaaaattttttgccaaatttattatacattatttttgcaagattattagatttctaaataactaaattttggttttattactctaacaatttttatcctttattatatatttccttatacttattttgagtataacttactctttctttttctcattttttgagatctgatcttagctcatgaattatcagcttttcttttttaaaaaacatgcatttggggctgagcatagtgactcatgcctgtaatcctagcactttgggaggtggaggcaggagtggatcactttgagctcaggagtttgagactaacctggccaacatggcaaaaaccatctcttaaaaaaaattagctgggcattggtgttttgcacctgtagtaccagctacttgggagggtgaggtgggaggattgcatgagctgggaggcagaggttgcagtgagctgagatcatgccattgcactccatcctgggtgacaaagatcccttctcaaaaaaaaatgcatttaaagcaatatatttctttctaatttgttttatctgtgcctctttattactaactgaaaaatccttaagatagccaactgaaaagggagagctacgtaatatagcttattactaaagaaaaagggaaaaaatttttctatgcaaccacagtgatcattcaaattataaaattaaaaactcctaattacattagatacagaaatattatcacacatacaagtaacatgacaatacaaatgttatgtattttggaaaaatcttatcatggaacatgtagaatttgtttggaaaaaaatctatatggattgaggccaggcatggtggctaacacctgtaatcccagcactttgagaggcagaggtgggtggatcacgaggtcaggagaacaagaccatcctggctaacactgtgaaaccccatctctactaaaaatgcaaaaaacaattagccaggtgtggtggtaggcgcctgtagtcccagctactcaggaggctgaggcaggagaatggtgtgaacccaggaggcagagcttgcagtgagctgagatcgtaccactgcactccagcctaggtgacagagcaagactccatctcaaaaaaaaaaaaaaaaaaatctatagggattaagaataatctaaagaattaggttaccaaattagacttacaggaatcagattttacccagtatcaagttttattaaaaattcaaaggtacaggtaattgtgaaaagcagaaggatgcaaaaagtttttccagctctactagctgtgagagtttagaaaatttatataaactcttttagttacaatttccttattttataaactgaggataatattgcctactcacatggtgtattgtgtattcatctgttctcacactgctaataaagatatacctgagactgagtaatttataaaggaaagaggtttagttgactaacagttccacatggctgaggtaggactcacaatcatggtagaaggtggaggaggggcaaagtcacatcttacatggcagcaggcaaagacagaacttgtgtaggagaactgtcctttataaaaccatcagatctcatgagacttactatcatgagaacagcatgggaaagacctgcccccatgattcagatacctcccactgggtccctcccacaacacgtgggaattaaggagctacaattcaagatgggatttgggtggggacacagctaaaccatatcattctgactctggcccctccaaaatctcatgtcctcccatttcaaaaccaattgtaccttcccaacagtcccccaaagtcttaactcatttcagcattaactcagaagtccagagtccaaagtctcatctgagacaaggcaggtcccttctgcctatgagactctgaaatctaggcagaggttcccaaacctcaatttttgacttctgtgcacctgcaggctcaacaccatgtgtaaacttgcaccctctgaagcaacggtttgacctctacgttggccccttttggccatggctgggacacagggcaccaagtcctgagactgcacaaagcagcaaggctctgggcgagacccatgaaaccattttttcctcctaggccctgtggcttgtgatggtgggggctgccatgaagatctctgacatggcctggagacattttccccattgtcttggagagtaacatttggcaccttgttacttatgcaaatttctgcagccaccttgaatttctcctcagaaaataggtttttcttttctactgcattttcaggctgcaaattttctgaacttttatgctctgcttcccttttaaacataagttccaattccaaaccatatctttgtgaatacataaagctgaatgcatttaatagcacccaaatcagctcttgaacactttgcagcatagaaatttcttctgctagatactctaaatcatctccctcaagttcaaagtgctatagatctctagggaagatgcaaaatgctgccagtctctgctaaaacatagcaagagtcacctttatttaagtttctgacaagttcctcatctccatctgagaccaactcagcctagacttttttgcccatatcactatcagcattttgctcaaagccatttgacaagtctctaggaagttacaaaatttcccacatcctcttgtcttcttctgagccttccaaactgttgcaaactctgcctgttacccagttccgaagtcacttccacactttactggtaccaatttactgtattcatctgttcttacactgctaataaagacatacccaaaactgggaaatttataaaggaaagaggtttaatagactcacagttccacatggctggggaggcctcacaatcatgttcaaaggcaaatgagcaaagtcatgtcttacataggagcaggcaaatagagaccttgtgtaggcgaactctcctttataaaaccatcagatcttgtgagacttactcactatcatgagaacagtccaggaaagatctgcccccatgattcctttatctcccactgggtccctcttgtgatacatgggaattatgggagctacaattcaagatgagatttgggtggggacacagccaaaccatatcacatggttagtgttaacaggatgatgtgcatataaggttaccagagtagccagcacatttaagaatgcaacaagttatatattaatgtgataatttagtattgctgttatgattccacatatcttatatttaattttaatcttcctatgtatataattaaaggtctattatcaagatgtaatccagattcatttctgcaacctgccttactatttttttcttaaacacagacagcacttgttgtatttctcgcctatgagttttcaatgaccttttaatagaaatgcttaattctagaaatatgaatggaaaatggtcatttatttgtacatctcttagggatttaggtgtataacataccatagcacaagaataagatatggtggctatcttccaagatgtttatagattaccagtggtaaataaaagttaaataatataattttatccttggtgctaaaaaaaaacactgaaaaacaaatgtgtgagtataaatgatgttagccattgacttgaaatattttcctaaataacataagcctaatatattatgaaaggtgtttcaattgctcaggacagttataatacatataatcaaattctatacattgaaaatatttcatatattccaagttctacatgtaacagaatgacatatataactgtactatggagattgaaacattctaatgcatttaaaaagaatatgttctgaaaatgacaaattttctcaaaacagtgcatttatactcctgcaatatagtaaaagtccctgtaaataatttttatgcagtatacaacagcataaaatactatattttcttgttcagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgtaagtatttaaaatatattccttcttctaattgagtaattcttttgaatggctttattttttaaagtttattgtttgtgggtaagtgtactttagttatgatacagcactcatggttgattcaggagagatggacacactggagactttgtttctatataaatacagtcttcatgaattcagtcttcaatggtgtatcacggatataatgctaaacttgtgacccattattttaaaattaaactgcaagcaaaatatatattatttactgatatttcaaaattctgttaaagatgtccttagcttgggttatcggaaggctcttcacaaactgtcttcctcatccaggagtctttaaataaacttaccacatgttactttttttttttttttttttgagactgttgctcttgtgccccaggctggagtgcaatggcacagtttcggctcactgcaacctctgcttcaatggcgcaatctcaactcactgcaacctccgcctcctgggttcaagtgattctcctgcctcagccccccaagtagctgggattacaggcacctgccaccacgcctggctaatttttgtatttttagtagggacagggtttcaccatgttggccagggtggtctcgaactcctgacctcaggtgatctgcctgcctcggcctccctcggcctgggattacaggtgtgagcttccgcacccggccccattccttttaattttctagaatactttgtgctctgatagggacacaactgcctgaagaaggaggggtgtggaggagaaaattaaatctgagtgtaggctgattaccaaagatggtattggatttgtgaataaaattaaacgagtaccatgaaaattatagaagaaaatcttaaccacctgtcataggggagtaaaattaaacttgtaagctgaaaaaataggaaattcaactagaatatgtgatattagaattgagattgataacaggaacaaaaccaaaagtgtcaagactaggaatgttttcagaaaaaaatcaatagcagggaatgagtaattaaaaatttgacatttatgttctgaagaatgaactttttctttgtttagatacaaaaataccattgtggtataactgcctacagtatacagtacagtaacatgttttgcaggtttgtagcctaggaacaacaggctataccagctggcctaggtgtgtagtagactacacgatccaggtttaagtgtactctatgatgtttacagaatgacaaaatcgcatgatgacagatttctcagaatgtatccccgttgttaagtgacacatgactatgattgcaaatttgaggaaatatgatcagagcttccagaaaatttgagaatggtcagatttttatactcttaacttataataacaaaaaggaaacaatgaatactaatcactttttagtaaagcaggtatgagggaattatagaaggaaatcttaaccacctgtcatagaagagtaaaattaaacttgtaagctgaaaaaattaggaaattcaactagaatatgctcactaaattcgttaaaaatattctttaagtggtagaaaatcgctaaaacactgaaagtgatctaaggcatactatgctacaatcactttaattccattaaactctaatgttgattaatattgcatcagattccaaaattttagtttccagaaacccatgaatcactctgctgatttcaggttgtgctgggctgtaagagttttaatggcagtggtaattcctgtcttttttactatagtgagatagcagtttccagataacaaagtttctgatctgagatgtgggaggtcagtaacagggacttccaagcagctatgattctgcactgcaatgtcaaaataccaggaggtaaatctaggtcaatgtcaggatggaaactacaaatgggtaagaagcctagtaccttcttaacagtggactaccgcgaaaagcaggagccatggtagaaggtggtccaagcacagtgaataatagacaagttactttactttgctacattcttttgtggacctccatggatgctatttaatggcctgtttccaaacacccaggacaatagatgttgggtcagtatcagtttccagaacccacttcctcactcatgtgtgagaaaatggatgagtagagaagatcctgatgtactatacgtcccccctttcagtggctcagaattgggcagccaggactttgacatggcaaaactcactgctgtcaatgggtgggctgtgacagccaccaaattacagtaggagagtaaatgagaaggaaattcatttttatgagatgtttaatattaacagaaagccttaagctctctataaaaaatttgtgatttaatcctcacatcaatgctttgaggtagctatgacaaactattaatagtaagtaaaagatcaatgtatgcactaaatccacaatctatgtttgttctatagcacatgccttttctctcctcttctccttgggacactaatgtattagcttcttattgttctgtaattaattaacataaacttagtggcttacaacaacataatttagtatctctcagggtgaggtttatctggtcctctgctcagtgtctcacagatcatcagagtgtccactgggctgtgaccatttctggagcataggatcctcttccaagctcaaatggttgttggcaggattcagttccttgtggttgtaggactgacatccccactttcatgatggctttcagcagggggcccctctttctactagagactccctagatccttgccatgtggcactttctcaagctctgttagcaacacaaaagcttaaattttcaaagctagcaagggagagtctgtttctctctctgttattctgactaggtgaagtgtgatataacctaatcaggggcctatatatcccatcgggttttgcagtattcccaaatcatagattctgcccccactcccaacatttaaggaaaggggattgggtgttcccttagtcacatttagtaacatcatcagtctatttctgactctgttaattgcattagcaatggggttgtatgctttataaacacaacactaaagtaattcaattaaaatctatttattgatggataagttgtcaggtctgtggccttttgtttatctctgactaattaaaccatgatcagattgacgggctgtttaagtgatgttatctaatgaacttttgaaaatgttaccttctatactttaaaacttttcactttgtcaccctgactaaaattaaaaaaaaaaaaacattttgagtcacagtaactttttaaataaatgcaggctgggcgcagtggctcacacctgtaatcccagcactttgggaagccaaggagtgtggatcatgaggtcaagagatggaaaccatcctggccaacctggtgaaactccatctctattaaaaatacaaaaattagctgggtgtggtggcatgtgcctatagtcccagctactcgggaggctgaggcaggaattgcttgaacgcgggaggcgagccgagattgggccactgcactccagcctggtgacagagcaagactccatctcaaaaaaaaaaaaaaaaaaaaaaaaagaaatgcaaagatatctgataagattaagatactattacctattgataacttggtgtgctatagcttaatcatgttaattacatcttaacttccacttcatgtcagcagctctgagtaaatactgatagatgggaaaaataataaataattttgaaacattaaaatcattgggagaggcattaaaatcatgggggtggtgccaccataaaggagagatttgagcaaccagaggattactaaacagacagtgggagggagagaggagacagagtgagaaaaagagagttgggaggcccctttttaaaattttgttttttaaggcatatcagattgaatataagcttatcatgtgtattagttaggattttggatcataagcaacagaaactgactctggttcattaaaacaatcacaataaacaaaaagggaaggggggacagatggaagaatatcaggtagctctcagaatagaagaacaacaactagatgctggagatacaaactctaaggcaactctggaagtctcttcaaggtacaacactggaatcaatcagttacaactacttgcatttgggagttactaggctcacagcttaatttcagggatagggagtcagattgttgtagtttatttttatacccacccttgaataaatgctgagggagaagtgccctttgacaggcagttttactgagtttacatgcaattggcaaaggggcagcatttcaaaagagaaaatatttcagaagaagggggaaatgatgataagtaaagaatattaaaatctaggaactgaaacatgacttagaattttagtttctaaataattttgactcattttatttttcatccattaattaatgaatccaacatacacttttgaactcctctatgtttctgtcagtattcctggtattgggactgtgggaacacacaatatctttgccctcatggagcttacattctaatgtaagagatactaaacacatatgtattctgtcagttagtgataagtgctaggaagaaaagctaatgcagaataaggggatagagaatgatggaaatgatcagagaagtcagattttatgaaacaggagaaagaggagagagagacaattaaataccttgaagaagtgcattctagggaaagaaaacacaagtgcaagagcccaggtattgcaacatggtctgcaaatagaaaaacaaattacaaaaaataaaaaccataataattgggaagaaagtcattgttgtgaaagtgcatgagtcaaatgggagacctggtggaaatagtgcttcagaggtagccagggaccagattatcatttagggtctcatagcccatgaagggattttaaccttggtgtgactggcatgttatgatttacatggcaaaaggtcatgtgtggatgccaaaaggagtttcagagtgacctgttagagtgctgtgaaatttgtctaggtgaaagatgacagtggcccatattctgtgttagggatttagatttgacatgaagaatttgattttctctctctttttaagacatgagcaggactgaacagacagtccttgaagcaaatcaggttcattgctcagtttgaccactaacatgatggagaatcctgggcaaatcatctgatgctctcacatgttggtatttgattgcagtgcttataacaacactggcttttaaaatgcaattataaaatactatggtaaaaataattggtttcttcataaatgactaatttctggggaaaaaaagttatgtttgtatgtatttgtgggagctgtggaaagggtaggagaagagagggacttataaatgagctgtgaaatgcagattaagatcctctgagaaaacttggcccgattgttttttcttctactttctccaattaacgatgtttcctttgagcgaatgaggcatctgaagatcattatgtttcagtagagcagtgatgcaaagccacttctcaggaatgactcagaggaattgctccctggaagaacatcagggtttttgccttttagattcaggctgtttaaaatccaaatgcaatatggttcttatgctgtcgtcctctggtgaaatggcacataagatggggaattgcagtctcaaactatatttaagggctgcatgctgatcaaagaaaaacactttgtggggctattaatttgtgaaaaatacagtattttggaggaaaaccgcacttcaatggagtggaagggggattcatatctagaaaagaaagtttccatttgaacttaaaagggaacataggttaataaagaacggtgtggatactgaaagtaatttatatttctgacacaaatggtgatcatttatgacagaagaatgggaaataaaggaagagaattatttgtgttaaaatgagttagcaaaggacagaaattaaaaactcattgacagtagactggtattctaaaagcgtgtcacgctgaatcttcttgttctgtctgcggcagctagattgaaagttacatttgggatgtacatgttgcaaaatgcctggcctgcagagtcagaaagaactgtgttctcaactggactcctctaatcattagttgtatgatcttgggcaaatttctacctccaaaaattttattcacaaagttagaatgtaaagccccaaacatattacttcgtccattttaggccctatgtgaatgtcaatctcccctctcccaaagaatgttacatactgtgattgctttttaacaaaagactttgctatgttcttgctatagttgaattataaaggggttccttgtgtctctgaataataatgtgtttcatttttaatatattcaagaaagaatattcaaatttctcctacaacttatgaataaataacagctattacttctttatcatatatttgcattagtttacaaagttgcccggaaaattttcatacagcagtttaagaaactactatttgatcatatattaagtagtattcaaaaacaattgtatcttgatacctttgttctattgtttagacataagcaaacatctattataatatttcttataaaaattattttttcactgtatagatgtattatttcagcatagatgtgactattaaagctgaggcttcttgttttcggtgacatagttttgcctcttatttttccatagaaatgtcttagtaagtatttagtgtaagttctttcttattaatactaggtttataagtgtaacagaacgtacttgtcatgcagtgagacttgagaatcttatgactctattgggaatttttatcatgtgttgtattacagatttaataacaatggaacacaaagtcttttaagaatatttcttgtaacaactatctgttgaactatcacaaaaatccatgatttcattaaaagatttaatgtctgactgtacaaaaatattacttgccttcctcatgcagttattcttatagagtattaaagtcatcttgaatggtagtgctacatttatcaaaatgacttagtttcacatacatgcaattgtgttttatatgtatgagcagaatgcttttgtactcgaggatttacctcatgatatgaagaaccattttagagaaacatagataattaagtccaggctcaagtcatacaatatctagaaaattttggcaagatttggttgtttctagtagagtgtgggtctgcatggtcactgttctcagtcaaaccctgggtctatctgcagagaagtaataaacaacttggcagtctttaaaaacctggaacataattccttatttgtctctcctctttcatccactgaacatttagtctaagaaaatggtggtttagttggtttaatattcaaaggtgatattataataggcttggtttggctaaagagatgaaaatgtggtcagatgtccttagtacgtttgcagtatccatttgtggttctgaggaaatgtgtgtgtgactctacctatttgatggcttacataaaatttggtttccaaatgagccactaaattgggctcattgtacagcaaggtccatcagtgtatggttaaatgttctttcttcttcattagatatttgtcaactagactgatgtgaaatctacgttggacaaaaattcttccctggagcattcatgctcaatttcatttttttgtaaactgataatattaccatattcttgttaaaagtttccaaacactacttttcactttttatttttttatttttgtgggtacatagtagatgtatatatttatggggcacatgagatgttttgatacaggcatacaatgaataataatgacatcatggagaatggggtgttcgtgccctcaggcatttatcctttgtgttacaaacattccaattatactcttttagttattttaaaattacaattaaattattgactatagtcatcctgttatgctatcaaatagtgggtcttatttattctatttttttggtatcttttagccatccctacctcctcccaaccaccctgctacccttcccagactctggtaaccatacttctacactctatgttcatgagttcaattgttttgatttttatatcccacaaataagtgagaccatgtgatgtttgtctttctgtgcctggcttatttcatttaatataatgacctccagttccatccatgttgttgcaaataacaggatctcattattacgtatggatgaatggtactccattgtgtatatgtaccacattttctttatccattcttctgttgatggacacttaggctgcttccaaatcttggctactgtgaacagtgctgcaataaatgtgggaatagagatatctcttcaatatactgatttcctttctttggggtatatacacagcagtgggattgctggatcatatacctctaattttagttttttgaggaacctcaatactgttattcacagttcttgtactaatttagattcccaccaacagtatacaagggttcccttttctccgcatcctcaccagcatttgttattgcctatcttttggatataaaccatttaaactagagtgagatgacacctcattgtagttttgatttgcatttatcttatgatcaatgattttgaacatcttttcatatgcctatttgccatttgcatgtcatttttttgagaaacacctattcatatcttttgcccaattttaaatcagattattaaattctttcttacagagttttttgagcttcttatctattctggttattaatcccttgtcagaggggtagtttgcaaatattttcccccattctgttgattgtctcttcactttgttgattgtttccctcactgtgcgtaaactttacaacttgatgtgatctcatttgtccatttttgctttggttgcctgtgcttgcgggttattactgaagaaaatttttgcccaaaccaacgtcctggagttttccaatgtttcatagtagtttcatagtttgtgttcttagatttaagactctaatccattttgatttgatttttgtatatggggagaaataggggtctagttgttctgcatgtgaatatctagttttcccagcacattttgttgaagagattgtcctttcctcagtgtatttcttggtaccgttgtcaaaaatgagctcactgtatatatatggatttatttgtgggttctctgttctgtttctttggtctgtgtttctgtttttatgccagtaacatgccattttgtttactatagctctgtagtataatttaaagtcaagtaatgtgattcttctggttttgttccttttgcttaggataacttcagctatgcaggatcttttgtggttccatataaattttaggattattttttctctttctgtgaagaatgccattggtattttgatagagattgcattgaatctgtagattgctttgggtagtaaggacatcttaacaatattgattctgctaatacatgaacatggaatatctttccatttttggtgtcctcttcaatttctttcatcagtgttatatagttttctttatagatatatttcacatattagttaattcctgggtatttaattgtattcgtggctatagtaaatgggattacttttttgatttgtttttcaaattgttgatttttgtattttgattttgtatcttgcagttttactgaatttgttcatcagttctaatcattttaggggggagtctttaggtttttccaaatataagatcatattgtctacaaataaaaataatttgactttttcttttgcaggttagatgccctttattttttttcttttgtgtgattgctcttgctaggacttccagtactgtgttaacagtggtgaaagtggagatctttgtcatgttccagatcttagagaaaaagcttcactttttatcccattcagtatgtaccagcatgggtctgtcatatatagcttatattatgttgagatgtattccttttatacccagttttttgagggttttttattatgaagagatgttatacttcatcaaatgctttttttttttttttttttttttttttgagatggagtctcgctctgtcccccaggctggagtgcagtggtgtgatctcagctcactgcaacctctgcctcccgggtttttttttttttttttttttttttttgagatggagtctcgctctgtcccccaggctggagtgcagtggtgtgatctcagctcactgcaacctctgcctcccgggtttaagcaattctctgcctcagcttccagagtagctgggattacaggtgcgtgccaccacgcctggcaaatttttgtatttttagtagagacagtttcaccattggtttcaccatttggccaggctggtcttgaactcctcacctcatgatccacctgtctcagcctcccaaagtgctggaattacaggcatgagccactgtgcccagcctatcaactgctttttaggtatcaattaaaacaattatatgatttttgcccttcattctgttgatatgatgtatcacattgattgatttgcatatgttgaactacccttgcatccctgggataagtctcacttggtcatgatgaatgatatttttaatgcattgttgtgtttagtttgctagtattttgttgaggattttcacagcagtgttcatcagagatgttggcctgtagtttctttttttaatgtgtctttgtctggttttggtatcagagtaatactggctttgagaatgagtttggaagtgtgccattgtcccctgtttttcagaatagtttgagtaggattggtactagtgcttctttaaatgtttgatataattcagcagtgaagtcaggtcctgggcttttctttactgggagactttttattacagatttgatctttttacttattattgatctgttcagtttttggatttcttcctgtttcaatcttagtaagttttatgtgtctaggagtgtgttcatttctcctagattttccaatgtattttatgtgttcatttattctgtgttcatttattctatatattccaaaggatcatagtgactactaatgatcctttgaatttctgcagtatcagatgcaatgttccctttttcatccctgattaaacattacttttctactgtttgctttttgatatcacaaatttaataactttacagtaaattcttgtttttaagttttcagcacttaggattcttatttgaaagcaacagaagctgattcttaagctaaaagaaaaattattaaattcgtagttatttacaatgattttcttaaaatagatttaatatcaggtaaaagtacagataatgcaactattcttgatctttttagctacattcagttttggcaagaatataatagataggctgggcacggtggctcatgcttgtaatcccagcactttgggaggccgaggcaggcagatcacctgaggttaggagcttaagaccagcctggcccacgtggtgaaactccatctctactaaaagtagctgggtgtggtggtgggcacctgtaatcccagctattctggaggctgagacaggagaatcacttgaacctgggaggcagaggtttcagtgagccgagatcatgccactgcactccagcctgggtgacagagcgaggctccgtctcacaaaaaaaaaaaaaaaaaaaaaaaaaaaaaaaaaaaaaagatattgcccctaccagtaaatattagcttttaaattattttatttttaattttatagaacaacaaaagacatcttgtttaatttacagttattttaatttgcctttctttgtttccttgttaagctaaattttctttaatcatttattagctatttgtatttattcacgttgctgttgtgaaaagaaaaaaaaatcttgggattcccaaatcactaagccaaagggaaaaatcaagctgggaagtacttagggcaaacctgctccactgtattcctaaaaaagatagctactaagattaaaaagctgcatacctccctcacaattggtccacaaggaaattccttgcagacaaaggacaaacagaactcagcagaaaccctttgctcactgagataaatgcatatctaattgcttcctttggaaaggaatcagaaattcaaaataatataaccatttgtcttccatctacctatgacctggaagccccctccccactttgagttgtcctacttttctgcgccaaaccaatgtccattttaacacatattgattgatgtctcatatctccctataacatacaaaacccaagctgttccctgaccactttgggcacatgttgtcaagacttcctgaggctgtgccacaggtgcatccttaaccttggcaaaataaactttctaaattgactgagacctgtctcagttatttcgggttcacagtgtgaattatctgatagtggattttgcctatattttctactgtgctttaattatgtactgctgatatacagagctatctatattttatatagatatattacagtatagacatagtaccatttatggaatggagaataaaatttttcagaaaaatattttacctaatatatttatccaatatatatttgctggtcatgtgaaaatttaacaaatatcaaatgaaaaagaaagaatatatatgtgtgtgtacctatatatcatatataacatgttattaaatgtataagcatttttattaaagtataatttatatataataaaaatgtatattttaaactgtgcagtttgataacttttgatacatgtataaaggtgtgatataaaccatttgtgatataaactgtgcgatgtgataacttttgacacgtgtaaatctgtggtataaaccatcaccgcaatttagataatgaacataatcaaattgctcccaagagtttccttgcaacttttgtcattctttcctcttgtgtgtccttgtgcccaccctctgttccaagcaaccacttatctgctttctgtcagtaaactttattttatattttgggagggaattaaatagcattaattaatacatggaattaaatagtattattattttttagtctagcgtttttcactcggcataattatttggatcttgatccatgttgtgttgcataacaatagttattcctttttctttctgaatagcaatccactgtatgaatataccatagtttatctaagtatatgttgatgaacatttgtggctattatgaatgaagctgccatgaacatttatttataagtcttagtgtgagcatgtgccttcatctctcttgagtaaatacttagaaaagaaacaacttaataattgggtaggaaaaacttaatcatatgttaaacttctgaagcaactgccaaactgtttttcaaaatggttgtatcattaggtatagataataattgtctatgaatgtcaaaatgtcctatggtagtcacagtgaaaaacacaattaacaaagaaatttggtcacctctgtgatttacaatgacctaacacaataaccctaattatgattgataacacaacctcagacatcagaactctagaaatcccgtacaattttggaacacattttaacatttttcactaaaatatggcctgaagatcaaacaccaccttactccaacaatcctatgcaggccgagcacggtggctcatgcctgtaatcccagcactttgggaggccgaggtgggtggatcgcctgagatcaggagttcaagactagcctggccaacatagtgtgacccctgtctctacaacaatacaaaaattagccaggcatgatggtgggtgcctgtaatcccagctactcaggaggctgaggcggaaaaatcacttgaacccaggaggtggaggttgcagtgagccaagatcgtgctactgcactccagcctaggtgacagagcgagactctgtctcaaaaaaataaaaaaatcctatgtaactaaacatgttaaataatcctgtttatcactcctttggacactccaggggctctctttagcattgaaatgctagggattaggaaagacaatttcgaagctttataggcttaacacacttaataggatttcaggttattataagtcatccatttaaatcatgactcaaagtgaaaaactttattcactaaaagggaagacttagtcttccaaacaatttatctcatgtccttcccttcttttgtcagtattttattcacaaagcaaacaaaaatctttcattgcatgaaaatcttgacaaagagaaagcaacatttcacccttgcattagtctattaatgtcaaccccaattctttaaaaaataaaaccttacagacaaatccatttaatcttaatcagtttgaccatgagctgagattcttataaatcttttataacacttcataagtttttgttaaagagcatattagttcctaaggaaaaccttgttgtgtttttattttaatgttcaatttacagaaaaaccaaataatactcttttgaatttagtcaatatgttcacacacagattttctctttaaaagatcaatttttacaaaccttgcataacttgttttagccattagctttatcttatctaatttaaaacaatcctttaatcctctgaacgagatgaaaatttacattccgtgttcttatattcttttactaaagacacattttactctccttacacactttgtatgtaaatctattttcagtagactccactacatgttataatggtagctcttagcaatttttaattttgaaatacctggtaagttattttagttacatacttagatgcagataaggtctgactattttcagcatagctaggagcatggcatatgtccccaggccttaccaaactgtaaagcaggaaagttgaacaattttcttctttttctttaattatactttaagttatagggtacatgtgcacaacgtgcaggtttgttacatatgtatatatgtgccatgttggtgtgctgcacccattaacttgtcatttacattaggtatatctcctaatgcaatccctcccccctccccccactccatgacaggccccagtgtgtgatgttccccaccctgtgtccaagtgttctcattgttcatttcccaccgatgagtgagaacatgcggtgtttggtgttctgtccttgcaatagtttgctgagaatgatggtttccagcttcatccacgtccctacaaaggacatgaactcatcattttttatggctgcatagtattcatggtgtatatgtgctacattttcttaatccagtatatcattgatggacatttgggatggttccaagtctttgctattgtgaatagtgccccaaaaaacatacgtgtgcatgtgtctttatagcagcatgattgataatcctttgggtatatacccagtaatgggatgcctgggtcaaatggtatttctagttctagatccctgaggaatagccacactgtcttccaccatggttgaactagtttacagtcccaccaacagtgtaaaagtgttcctatttctccacatcctctccagcacctgttgtttcctgacttgttaatgattgccattctaactgatgtgagatggtatctcattgtggttttgatttgcatttctctaatggccagtgatgatgagcagtttttcatatgtctgttggctgcataaatatcttcttttgagaagtgtctcttcatatcctttgcccactttttgatggggttgtttgatttttccttgtaaattcaaagttctatgtagattctgcatgttaaccctttgtcagatgggtagtttgtaaaaattgtctcttgttctgtaggttgcctgttcgcactgatggtagtttcttttgctgtgcagaagctctttagtttaattggatcccatttgtcagttttggcttttgttgccattgcttttggtgttttagtcatgaagtccttgcccatgcctatatcctgaatggtattgcctaggttttcttctagggtttttatggttttaggtctaacatgtaagtctttaatccatcttgaattaatttttgtataaggtgtaaggaagggatccagtttcagctttctacatatggctagccggttttcccagcaccatttattaaatagggaatcctttccccattgcttgtttttctcaggttcgtcaaagatcagatagttgtagatatgcggagttatttctgagggctctgttctgttccattgatctatatctctgttttggtaccagtaccatgctgttttggttactgtagccttgtagtatagtttgaagtcaggtagcatgatgcctccagctttgttcttttggcttaggattgtcttggctatgtgtgctcttttttggttccatatcaactttaaagtagttttttccaattctgtgaagaaagtcattggtagcttgatggggatggcattgaatctataaattaccttgggcagtatgaccattttcacgacattgattctttctatccatgagcatggaatgttcttctatttgtttgtgtccttttttatttcactgagcagtggtttgtagttctccttgaagatgtccttcatatcccttgtaagttggattcctaggtattttattccctttgaagcaattgtgaatgggagttcattcatgatttggctctgtttttctgttattggtgtataggaatgcttgtgatttttgcacattgatttggtatcctgagactttgctgaagtgacttatcagcttaaggagattttgggctgagatgatgggtttttataaatatacaatcatgtcatctgcaaacagggacaatttgacttcctcttttcctaattgaataccctctatttctttctcctgcctgattgccctagccagaacttccaacactctgttgaacaggagtggcgaaagagggcatccctgtcttgtgccagttttcaaaggcaatgcttccagtttttgcccattcagtatgatattggctgtgggtctgtcataaatagctcttattattttgagatatgtcccatcaatacctagtttattgagagtttttagcatgaagggctgttgaatttcaccaaaggctttttctgcatctgttgaaataatcgtgtgttttgtctttggttctgtttatatgatggattacgtttattgattgctgtatgttgaactagccttgcatcccagggatgaagccaacttgattgtggtggataagctttttgatgagctgctggattcagtttgccagtattttactgaagatttttgcatcgatgttcatcagggatattgatctaaaattatgttttttttgttgtgtctctgccaggctttggtatcaggatgatgctggcctcataaaatgagttagggaggattccctctttttctattgattggaagcatttcagaaggaatggtaccagctcctctttgtacctctggtagaattcggctgtgaatccagctggtcctggactttttttggttggtaggctattaattattgcctcaatttcagatcctgttattggtctattcagggattcaacttcttcctggtttagtcttgggagggtgtatgtgtccagaaatttatccatttcttctagattttctagtttatttgcatggaggtgtttatagtattctctgatggtagtttgtatttctgtgggattggtggtgatatcccctttatcattttttattgcagctatttgattcttctctcttttcttctttattagtttttctagcagtctatcaattttgttgatcttttcaaaaaaccagctctgggttcatcgattttttgtaggatttttttgtgtctctatctccttcagttttgctctgatcttagttatttcttaccttctgctagcttttgaatgtgtttgcccttgcttctctagttcttttaattgtgaagttagggtgtcaattttagatctttcctgctttctcttgtgcgcatttagtgctataaatttccctctacacactgctttaaatgtgtcctagagattctggtatttgtgtctttgttcacattagtttcaaagaatatctttatttctgccttcatttcattatgtacccagtagtcattcaggagcaggttgttcagtttccaggtagttaagtggttttgagtgagtttcttaatcctgagttctagtttgattgcattgtggtctgagagacagtttgttataatttctgttcttttacatttgctgaggagtgctttacttcctactatgtggtcaattttggaataggtcagatgtgctgctgagaaaagagtgtatattctgttgatttggcatggagagttctgtaggtgtctattaggtcctcattgcagagctgagttcaattcctggatatccacattaacttcctgtcttgttgtctgtttaatgttgacagttgggtgttaaagtctcccattattattgtgtgggagtctaagtctctttgttggtctctagggacttgctttatgaatctgggtgctcctgtattgggtgcatatatatttagggtagttagctcttcttgttgaattgatctctttaccattaggtaacggccttctttgtctcttttggtctttattggtttaaagtctgttttatcagagactaggattgcaacccctgcttttttttgttttccatttccttggtaaatcttcccccatccctttattttcagcctatgtgtgtctctgcacatgagatgggtctcctgaatacagcacactgataggtcttgactctttatccaatttgtcagtatgtgtcttttatttggagcatttagcccatttacatttaagattaatattgttatgtgtgaatttgatcctgtcattatgatattagctggttactttactcattagttggttattttactcattagttgatgcagtttgttcctagtgtcaatggtctttacaatttggcatgtttttgcagtggctggtaccggttgttcttttccatgtttagttcttcctccaggagttcttgtaaagcaggcctggtggtgacagaatctctctgcatttgtttgtctctaaaggattttatttctccttcacttatgaagcttattttgactggatatgaaattctgggttgaaaattcttttctttaagaatgttgaatattggcctccactctcttatggcttgtacagtttctgccaagagatccactgttagtctgatgggcttccctttgtgggtaacccaacctttctctctggctgcccttaacattttttccttcatttcaattttggtgaatctgacaattatatgtcttggagttgttcttcttagtgaatatcttcatggcgttctctgtatttcctgaatttgattgttggcctgccttgctaggttgaggaagttctcctcaataatatcctgaagagtgttttccagcttggttccattctccccgtcactttcaggtacaccaatgagatgtagatttggtcttttcacatagtcccatatttcttggaggctttcttcatttctttttattctcttttctctaaagttcccttctcacttcatttcattgatttgatcttcagtcactgataccctttcttccacttgattgaatcggctactaaagcttgtgcatgcatcacatagttcttgtgccatggttttcagctccatcaggtcatttaaggtcttctctatgctgtttattctagttagccattcatctaatcttttttcaaggtttttagcttccttgcgatgggctcaaacatcctcctttagctcagagaagtttgttattactgatcatctgaagccttcttctctccactcgtcaaagtcattctccatctagctgtgttccgttgttggcgaggagctttgttcctttggagagaagaggggctctgattttcagaattttcagcttttcttctctggtttctccccatcgttgttgttttatctacctttggtctttgatgatggtgacctaccgatgtggccaaatgggaacagctccagtctacagctcccagtgtaagcaatgcacaagatgggtgatttgtgcatttccaactgaggtaccaggttcatctcactggagcttgtcggatagtgggtgcagcccacagagtgtgagccaaagcagggtggggcatcgcctcacccaggaagcacaaggggtcagggaattccctttactagccaagggaagccatgacagatagtacctggaaaatcaggacactcccactctaatactgcacttttccaagagtcttagcaaacggcacaccaggagattatatcccgctcctggctcagagggtcccacacccacagagcctcactcactgctagcacagcagtctgagatcgaactgcaaggtggcagtgaggctgggggaggggcgtccactgtcactgaggcttgagtaggtaaacaaagtggccgggaagcttgaactgggtggagcccacctcagctcaaggaagcctgcctacctctgtagactccacctctcggggcagtgcatagctgaacaaaagacagcagaaacttctgcagacttaaacgtccctgtctgacagctttgaacagagtagtggttctcccagcacggagctggagatctgagaatggacagactgcctcctcaagtgggtccctgatccctgagtagcctaactgggagacatctcccagtgggggccaagtgacacctcatacagctggatgcccctctgagacgaagcttccagaggaaggatcaggcagcaacatcttccattctgcaatatttgctgttctgcagtctccgctggtgatacccaggcaaacaggttgtggagtggacctccagcaaactccaacagacctgcagctcagggtcctgactgttagaaggaaaactaacaaacagaacaattttcaaaagccaaagcagtttatgaccttaaagcctttcaccaacctagtttctgacttgcataatttagaccatgtctacattttgaagacatttctacttttattttaccaataattttaaagctagcctgtttatatatagcaatatatgttgttataacatatgacagtaagtgtacaaataaacacatctagacatgtatacatacacaaatgaagatccaatagcttggaaccctagccataagatagcactacaagcttaccagttttactttgtttgccccaatagacaatccaatgaaggctgtgaaccaaaatttcaggtaaattggtttctatgacagtttgatttttaaaagccaaacttccccagactccaaagaacactggggccaaacagcaccaaaggagaacatcacaagttaaaacaggccccctgcttagaacagcagcacaaaaccctggatacatgcaatgcaatcttactttcctattcaacagtaaactccagattccatacaatattggggccaaacagtattgtaactgtgagagaaaattctaaggagggtttagtactagacctcagaacctctgccaagggcatcccgtttggagaggtggaggtccagaggatcccctgggatgtccccctgtgggatccaaccttagagtgtcagatgtctctgaccttaggtaggcactagtgctgctttgtcttctccctccagaggcaatggcctaccacgatctttgtaaggccatgctttctcaggcttcctgttccaccagagtgacagccatgaagtaaaaggcattgcagctttatttttctttcaaaatagttgatctaagcacttgattttctttaagccaatcagagctcttttatataaacatcatacacataacacatgtgtaactacacagactgaaggagattcagtacttgtaagatttttcatgtgccaatctcctatttgcattgctaaccctaggggtggagcacttcaagaaccaggtctaggaaaacatgcaggcaggttctatggcctaataagtaggaatagctggaagacaagaacagattttgagagggatacatccacttgtaatccctggcactccatgaggaaaacagaggtttttttcaaaaatgaatcaatgatgcctcctttgttttcccaagaagtcccaggacttcagaggttatcttggggcccttcatgtgtgcaataagaatggtaagacaaaaatggagactaattcagtcgactgataaaacctttttccagaaaaagaagatccatgagaaaagacatacaggccttttaaatatacctatagctttgataaccatggacatctacttttaaataagctaacttttaactatagcacccctttttaaagtcattttaaatctcttatttcctgactttagccatgccaaatggccatttgaattcttggaggggcagagaatacagtgatttttatccttcctgctaccagtttgcacagagaaagagaagtcagaggccgggcacagtggcttacacctgtaatcccagcactttgggaggctgaggcgggcacatcacgaggtcaggagatcaagaccatcctggctaacacggtgaaacaccgtctctactaaaaatacaaaaaacttagctgggtgtgatggcaggtgcctgtagtcccagctattcgagaggctgaggcaggagaatggcatgaacctgggaggaagagcttgcagtgagctgagatggtgccacgacactccagcctgggcaacagagcaagactccatctcaaaaaaaacacaaaaaacaaaaaacaaaacagaagctagaaatctgactggcaagaacctttacccttttgctggcatgtcaggcttctgggttcccttcccctgagacatggagtgctttgaccctggagtcctgtgaaggggaaaaagctattttctttctccagcctgagggtcaaaggagtccagtgatttaggatacacttgaggagtgcaggctgaaaatgattcactggttacccatctggaaagaggagtaaaaggcttccctttgttcctctctcttcctagcgaatacccggggtatgtgacagggagaaaaggcatccctcttaattatttcgaccttatatccctgagttccggtgacctgtgcaggtgctgaccatgggtgcaagtgcaaccttcacccatgaagttggaggcatagctgacaggcatgcacctgagcagagcctaagcctcccactctccgtcacatttgagttccctagaccctatctatgccatgtatgtaagcatgatattcccatccatgaagcaggaggcctaattgtcaggaattagtcatgctcacctgcactgtgcccttcgactcccgctgtcatctgcctcaggtctattgttccattccagggcttcaaactgaagcttcggagaaaaaggtgcctcaggggggtgtatgaacccattaaattggtcccagatagcccttgccaaattgcagctagcaactggcaggggctgctctaccattgcctccctatcacaagtaggtgaagctgtggggccaagtcctcctcaaacaagggagagagaaagggagtcccagtaactggggacctggcctacgaaggtgacaactaagagattgggtttttcctgagatgcccttcacggtcatgctaagagaggaggcggacctaggttggagaagagaactgaaaggcctgctcaagtccaggaggaggtccaacctcctttccttgatccctagaatcaccctagctcctggatggcaatgacagtctgaaccaccagagtcaacgaaaggaaccctgggaccagtcagtcctgctgcaccatttgggagatggcaatctggaccttgccacccatgtctcagggacagtctgccctccaatgatctacatttgcagcagttgacaggtgcattgtgaggactctgaggtttgtgagcctgcaagttggttattagagcctctgtctttttcttgtgtctccttccctctcttgggcctcccaatcctattttaaaaggccaaggtggccacttccagaggtcctctatagtactctctggtcgtatggcctgtttctgtagcttcctcctgatatcaggggctgaagtcccctcttagatttctgaggaaggcagtgggactctcatccaatccctggtctaccatggatagcccagtgcaatcaagaggtctagtcccagtcccttgcaagccatccaatatgcacacctgtaagggcttccttttccattctcccgtttcatcattggggtcccatttagtgttctccaatggtactgctattcttccaactagataaggctcatccccttccctggtcctatataagatgtaaagcttatcctaaaaattctctgccacttgcagggtggcctgcttttcagcagtggtcagggtttgatgcaaaagtaacatgacatccttccatgagagttcaaatagttaggttaagttctggaaggccaatatatgcctgtcagggccatctgaaaacctgcttggatcccccttaatttgctgtaagccctgaagagaaaaggggacccgaatctaaatgggaccgtgtttaccacacatctgttgtaggagcaggagtgagactgggacctgcctaaaatgacttctaagatgaggcaagcttggaagagaacctggatagggaggagtgaagggagctgattcccctgctgaaggtaccactggggtttgtttccccagttccctgggattgacccttgcagcctctcctgagatggtcactaggaaggctgaatcaatcccacaacgttggcaaagatctgggttacactacaaggcaaagaaaaatagtccaaggtcccttcacataagggacgttggactatttgccctcgtgtttatggaaaagctttcttcttgaggcaatgcttcttttctgtgcctcaaggtgcttagacctaagttgtcaaccaagtaaattacaagaacatttttaccacaagtttacatacagataccaagacatacttttctttgtctgtgctactcttaaccttatattatatactttcaatgactaagccaaatgctcattctacacagtagtatctttgtttggcaacattcttaacattttaatattgtatataaaagaagaaccatgacagcatgagaaaaaagaaagaaacaataataggaaagactaaggtcctagcgcggacaccctaatgggcagtcagggattggaattagtccaggggcctttggataacaccaaggtgtagcctcagccagatactctcagttgctccaggacctccatccagtcccaagtgactgctagacctccatgaagtgaaactgggttggaacaaaaccaacattcccaacaccagagagtgatgggggattaacagtgtcctccccagcaagcctgtcctccttaagtctggcaaccatgctagtcatttttaactggctaagagtccagtgttttttcttcattttggctattatggagtttagagactccaaaaaaaaaggacagaaagcaaattcacttttactcacccttcctgcagatgagccctcaaaatgttacgggatctttggggggtggattttctggccggaaacctctgtggctgcgggtggctttgcctgacttcttgttctgtatgcaggaagaaagaggtatgaagacaagcgaagggtgaacaagatgaagatgagctttattgagtgttccaacagctcagaggagacctgcagcaggtagctcctctcataggcagatcatccgtggagccttcagttctcaacagagaggaggccctggagagggtggcttctctctgcttgtggtcatcccattgtctccagctatcagcagagagggtacctcctctctgcagctggtcctcctgtcctgtctctgccttcttcatcctctggttgtcctctgcccttctctggctgagcccagggcttttatggacctcaaaggggaggaagtgcctgctgattggtccatggttggccatgggtgggcccagaagagccataatgagtccccactctggtctgcaggaccagcagtctggcccccagccttcgggacctccttggcctgaaggtgggggttcactgggaacctgcccccttctacccaggaatcaatctgcctccaggggccaggccaggaattaatcagcctcctggtgccagtcatggcccaggggctcttccccaactcccactccaagactggagcgggtgctggtgtgtccggaattggttgcttccggtcggttcttggtctcactgacttcaagaatgaagccgtggacccttgtggtgagtgttacagttcttaaagatggtgtatccggagtttattccttcagatgttcagatgtgtctggactttcttccttctggtgggttcttgctgacttcagaggtgaagccgcagacctttgcagtgagtgttacagctcttaaaggtggcacatccagagttgttcattcctcccggtgggttcatcgtctcactggcttcaggactgaagctgcagacctttgcggtgagtgttacagctcttaaaggtggcgcgtctggagttgttagttcctccggataggtttgtggtcttgctagcttcaggagtgaagctgcagacgtttgtggtgagtgttacagctcataaaggtagtgcagaccgaaagagtgagcagcagcaagagtttttgagaagagcaaaagaacaaagcttccacagcatggaagaggaccctagggggttgctgttgctggcttgtgtggtctgcttttattcccttatttggccccacgcacatcttgctgattggtccatcttacagagagctgatcagtccattttacagagtgctgattggtccgttttacagagtgctgattggtgtatttacaaacctttagctagacacagagcactgattggtgcatttacaatccttagctagacagaaaagttctccaagtccccacctgacccagaagcccacccggcttcacctctcaccaggagtggagagaggccaggcagccagaccagacacccttgagcctgcagaaaaagtgcgtgtggggggtccttcctggggcttccaagggtataagctgcagagacacctggtcctgtgcctaggagggtggctgaagccacacccaggaaggcagatcttgcttgctgcgggccctacccaaagagcacaagaaggctcggatacacagctgcagtttggatggctatagtcctgcccaggagggccaggctcctgtctgctctgtaaagcaggagacttgggtttgcagctgtggtttgggtgcaacccgggagctctggtcccaactcagaaggggcggggctcccactggcttcatggagtgtgcagcaccaactgagcctcccttctgcagccagtgtcatgtcttctgccatcaatgtcttctatctcagagattctttcctcagctgtctgctaatgagaccatcaaaagcattctttcttttacagtgtttatttctaacattttttaaattctttctcagaattttatcacttcttatattttccatctgttcttgcatgttgcctactctttttaataaggccattagcatagtaatcatagtttaaaaagattcctggtctggtaattccaacattcctgtcatatctcactctgaatccgttgcttgttcagttttttttttttttttaacctgcagttttgttgttgttgtttttgcctgctagtagctctgtaattttttgttgaaaggtagatattgagatactgggtaaaagaaactgcagtaaataggcctttgataatagcggtaaggtgtagggagaaagaaagtgttttatagccctgtgattaagtctcagtttttggtgagcttgtgggcctggactgggaatgttacatgtgcttctgagtatttttccccctccccttaggtgggacagaatggctagagtgggttgaagttgagcatttgccttcctcctggtggatttggctcgtctgacaaaaccctattctgttaggcttttgtaaaatagtttattttgaggacacaccttgttaagaaaaccgtattgctctgggttatttcaaaccatttttttgttttgttttgttttttaccactcacccggttggaagcttgaaaggatttttctcctatactcatcatgagggcctgataaggttctgggggtaaaattcacaaaaatgtgaattgcccccacccttgctcaagcatgagtgggtcctctggagtttctaatacctaaagaaagagtaaacactgaataaaaatgtattttctcttttagagacaagacaatcaaaatctgaattttactttgtaaatcaaagagaacgactaaggcaactctcaatcattttaggaggtttatccgccaaagttaaggacgtgcaccagggaggcaggtctatgcctttctccaaagatgattttgaaggcctcagtattcaaaggagaagggcagatatttggggaagagaaatattttttaaaagattcagtagataaaaggacagaatggttgcatccttttgagtctttgatcagcctttcacttaatatacagttttcctgtgagagggtggtagaggaaatagttactcataacttagtgtggcttagtgaatctgcattttttgtaagacaacatagacaatagggcagaggaagcaatcagatacgcatttatctcaggtgagtggaggaatgactttgagttctatcttttgtcctgcacctgtgaagataagctatcaatttacattgacaaggtgaaattcagcagaactgtttgagggtagagatcttggagcccacaaggaattttcttgtgggcaaattgtgagggaagtatgtagctttttatttttgtagccatcttatttaggaacaaaatgggagacagttttgtgtgatccagttcccagctcgaattttcctttggtttaagtgagtttggggtcccaagatttattttcctttcacaacttatttactgttttttttctctgcattttctcattttcttttaaatgttatgtttgctttatgttaactgtatttattgagtcttattgtgttttttaaaatctaactataaagctcatttaaaaacaacttttccacagataaataatacattaaacaaataagaacgcagatattttgattgaagagatgaaatttgtaaacttttctattctgttatttccccattttttgcagtgtctttataaacactccttcagaaccttctttgaaaaccactaccagtggcaaatccatcaatccttttctttgtgattttgtcccatgttttaatgtttaggaaattttacttaacagtgaactaattggtactactgttaagcttttccttataccactgaatgtttgatactttgaatctctgaaataaactgagaatggacagattaccagtagaaaaggcatacaaatttattatgtgcatacacatggagtctcacaaactataaggctcaatattatattataatattacctattacaatatgtatttttgagttattgtctaatacaaattaataatgtggaatacagtcatctaaatttttttctcctattcaactaaggactagtgttttatatatatatatacacacacacacacacacacacacacacatatatatagtgtgtgtgcgtgcatgtgtataaatcctaaaatcaatatcactagtactttaaacaatcatttttaacttagatttactcctatttttaaacttgcatttcttttcattttttttctgcctgaaatatattaatattttcattattgtggtctgctgatggcaaattctttcagattttatttgttcagaaaatgcctttattttcttttcattcttgaatgtttttgctgaatatagaattctagtttggcagtcatttttatttacaactatatggctttgtttcaactacaaactcagttatcagtctttctgttattccattgaaaataataagactctttaacctagctcatttttaacccagttgttttgaaaaattcttaaccatttacttactaaatatccctctaataagctatctttccctactccttctggaatttcacttagtaatatgttagcacttctaattatgtcctatgtgtcttatttttttctgttcttatgattttgtctcatcatgcttcagtttatgttttcttttgctcttatttcttgctcaccaattccccttttagctaggacttatctggtgtgttaatctcattcacggagttctttttttcaatttttattttagatttaggggtaaatgtgcaagtttgttacatgggtatattgtatagtgctgaagtttcaggtatgaatgatctgtcacccagttttactaagcatagtaatcaataggttttcaacccttcccctcttctctccctcccacctgtagtagtccacagtgtccattgttgccatctttaagttcctatgtatgtagtgtttagcttcctcttataattgagaacatgcagcatttcattttctattcctgccttaattcacttagaatttatgacctccagctgcatccatgttgttgcaaaggacatggtttcattcttttttatggctgtgtggcatttcattgtttacacataccaccttttctttatccaatccaccactgaagggcacctaggttgattccatgtcttggctgttgttgttcacagaattattaatttcagttatacgtttatcatttctcaaggctttcaatggattcttttttacagattacagttctttgccaaaaatcttcatgttatctttaatgtccttggacatttcaattataattattaatttgtgatgcagttttatcacattttaaatatatactttattctgtgtattagtttgttttcatactgctataaagaactatctgagactgggcaacttataaagaaaataggtttaattgtctcatacttccacatggctggggaggcctcaggaaacttatactcatggcagaaggcaaaggggaaggaaggcacatattacatggcggtgggtaaggggccagggagtggactgccaaacatttttataccatcagatcttgtgagaactcactcactattatgagaagagcatggggaaaccatgctcatgattcaattgcctcccaccaggtacctcaacaaatggggattgcaatttgagatgagatttgggtggagatgaaaagccaaatcatatcattctgtttcactgaaatttgtttagtcttatgctgatttcatattgatttaaaaatagctttagttttatgttatctttggataactgatgagacaatttattactattccgaaaatgtattatatatttaaaatagaaacttcctcactcaagaacatggtgtatattttgcatttattttagtcttttttactcaatacagttccatagagtttctatactttttttgaggtaattcctagtttttatatcgttttgtgaatattttgtgaataggattattttcttattatattttctaactaagcattgttaggatatgtaaaagctatttcactagctctctctatatttgtaaccaactgcctcaatgaacacatattaattctaaacatttcaattgtttttcttttatttatttttaagtaaacaatgcaatctgggaataattatcattttatctctcacatagatatattttattttcatttattatcttaatgcattaaatagaactttttttttttgagacagggtctcattctgttgcccaggctggagtgcagtggcatgatctcggctcactgcaacctctgcctcctgggttcaagcagttctctgcctcagcctcccaagtagctgggattacaggtgcccgccaccatgcctggctaatttttgaatttttagtagagacggggtttcaccatcttggccaggctgatcttgaactcctgacctcgtgatccacccacctcggcctcccaaagtgctgggattacaggcttgagccaccgtgcctggcctaaatagaacatttttaaacatagtattaaataattatgacaatagtgagcagttttttaatgtattttgttttaatagtatgcttctagtgatttaccatattgtgtgatgtaggctcttggtttaagggaagaaaaatgtaagagtagaagcatacttgtcaaaaagtcttgagttgaaaatctaaaatctaacttgcaactttgtagatataacatcatgaataatttatctaacctgagtctcttcatttttaaaaaggtgaagcatttagctagttcttaggatgcttatgaaacttaaggagatagtgcatatgaagtacttaaatgtacaaaattatgcacataataggtaagatacacagacacacacacacacatcttcaccatttttcactctgctttatgcctcaaccatgtgacttttacaaactgcatcagctgtactttctgaccatctagtttctggttggatttaatacaatggaagacaccagaacatattacaggtgaaaagagggtgaggtctgagttattattccctggttcctttcttgcctgttagacgaggttggctgttatcctattgccaaatgccatagtagtccctcttctgcaactgtagccctctcaggacatcaaggacccatattttccgttgtactttcaggcttacagacaacttcttgctgtcccctcatcccctcgttgacttccctcaccacttcctatttacttttgtaaataatttcttcattaaaaatccacttaagtgtcccttctgagggtgtaatcatcttgtttgatgaatctatgtaagcatatataacatttccaaacaaccctagagtgctaaaccagatccatactgtttggctcctacctactctagaattgtattctgaccactggccttgacaagtcatctgtagttttctgattgggctgctatttcatgtgcctgtgctaatgctctttcctctgctttgaatgtctcttctatccacttttcaatttcttctctgaagtcttttctgatacactaggtaaaaatttacagttatcttttaaacatctatctatacatggaattttatatagaattttctcatagtaatgcagtaataatttattttatttgcatgatcaaaagttgtacttttgttattaaactggaatctctgtaaaggatgtggccttgtcttttcatcattgtttttgccatggcttacatataattcatggcacagtaggtactgaagaaatgtttacataataaatgactctagctattattattaggagttagctcatacaatttatgttagaattgaaatattgtgagaaaggttgtaagcttcatcatgcagaagttgtgtttagtgtgaaagtagggcttatgtattttcaatgccctgacatgtttttgtagcaagttgacacattgcttttgtactaccaggtggaattccacagagcttaaaccagacagggattaacaacagtttgagctgtctgagagcactattgactctttttccagtagcattgaaacaggaaaaggaggggataaaagaaaatttaattattgcactattttaaaagcagtaatttgctgatttcggagagtgacttgatactgtggaattttgattttctccagtgctcacatagaaaagagtaaggcattaataaatatttattgactattgtacaaataaaaatttaatcttctaataaaaatttaatcttctaggaggattttttttacaatggaaaatataccccaaacggttactaagaggatggggaatgttttgtcctgtaattataatgataaatgttcaaaaatgtaattacagttttattttataattatgacaaatgtacatatgaagaaatattcagcttcataagtagtcaaggaaatacaaattaaaactatcaggaaatatgattatatgcccaacaagttgaaaaaaaattcagaagtgggaaaataaaaatttttgttaaggatatgatgctatagctgttacatgctaattttgggagtataaatccatacaattactttgagaaacaacattacctaatgtagataaacattcccatagttataattcacccttatgcctgtagtaccacagagcaactatgtatgtagttgcatatgtgtgctatacaatacttgtgcatatatgtaccaagagacacaagattattcacaatagcattgtttatgataaattgctattcacaatagaatggttgtaaattgtagcctatccacacaatagaatgctatattatggtgaatggactaagacaataatacatgcctatcatcatatttgaacctcagaatgttacatgttaaatttaaaggtgagaagcaaattatggttaataatgtgcaacatgattccatttgtatcaaatttgaaaataagtaataccaaatataatattatttaggaatataaatacacatgatgaattataaagaaaatcaaatttcttggaaatgttctattcttaagctggataatgtatgtttatgttcggtttctttttagtttattatttcaaatttacatgtgcattatgtttcatccatatcttttacatatcatataggatttttaaaaattatgtaaataaccttaaaataagtctattcccatttacaaatgcaaacactaaaaatccattaaaggcagggctaatgtgtttggaaaaaatctattgggaaactcctttaggcacagataaaatgaaaatattctctgtgttcaacaaaattaccttagtgtatacagcagattttcttgtttacattttaaaaaatattttatttttaattgacaaataatagttgtattttgtatggcttacagtgtgatgttttgaagcatgtatacgttgtggaatgattgaattaggtaaattaatatatctgtcatctcacatagttatcatttctttgtggtagaacatttaaaaccactctttttagcaatttaaaatgtacaatacattattattaactgtgcaatagacaaccagaaccttcctgtctaatgaaattttgtaccctttgatcaacatctcttcctgtctaccactgtccccatccccaccttcagcttccagtgaccaccattctactgtctacttatatgtttgacttttttagattttgcatataggtgagatcattgagtatttaactttttgtgcctggtttatttcacttagcacaatgcactctacattcacctatgttgttataaatgacagaattttcttctttttttaaggcataatagtgttccatttcgtgtatataccacttaaaaaattcatttatccattgatgagcacttcagttgtttctatatcttgactattgtgaataatgctgcaatgaatgtgggagtgcagttatctctttgacgtgctgatttccattccgttggagatatactcaaaagtgggattgctgggtcaaataataattctatttttagttttttggagaaccctcatctgttttccaaaatgtctgtcataatttatattaccaccagcaacgtacaaggagttctcttttctccccattcttaccaacacttggttatcttttttctttttgataataaccattttaacaggtgtgaggtgatatttcattttggttttaatttatatttttctgatggttagtaatgctgaatatttttttcatacctgttgaccacgcatattttttttgaaaaatgtctatcccagtcctttgcctatgttttttaaatagggatacttgttttctcattgagtaatttgagtttcttatatatttgaatattagcaccttacctgatttatgatttgcaaatattttctctcagtctgtgggttgtgcattgacctttttttttttttttttttttgctgtggataagctttttagtttgatgcaagctcatttgtctatttttgcttttgtcgtctagactttttgggtaacattaaggaaatcactatccagaccaatgtcacggagctttcccctatattttcttcttgtggttttatagtcttagttcttacatttaagtctttaatccattttgagttgattttcatataagggatgagataagggttcaactttattattctgcatgtggatatccagttttctaaacaccatttattaaagagaccttcctttctccaagattgctttggctgttggagatcttttgtaattccacataaatattagaatagtttttttctatttctgtgaagaatggctttgtaattttgatagggattgaatttaatccctagattgttttgggtagtatggatactctcacaatattaattcttcccattcatgaacatagaatatctttccatttatttgtgttttctttcaccagtgtcctgtagttttcagtatatagatctttcatgtccttagttaaatttacttctaaatatttcattttattttctgatgcttttataaatgctattgctttcttaagttcttttataaatagtttttagaaagtagaaatgatactgattgctttatgttggttttgtgacctactaatttactaagtttgcttatgagttttaacaacttttttttggaatccttaggattatcaataagatcattctatcggcaaacagaaacaattttactttttcctttcctatttcaatgtcttttatttctttctcttgcaaaattgctctgtctagaatttccattactatgctgaacagaagtggtgagagtggatattcttgttttattcctgatcttaggggaaaagtcttcaatttttcacccttgagaataatattagctgttgccttgtcacctatggcctttatagtgttggggaacatttctttaaaaattccaacaaattctttgggtttcctggatctggatttctatttcctttctcaggctatgccattatttctttcaatataatttttgtgtcatccaatctttcttctcattctgatacactaattattcatatgtcatccacttgatggtgtcccataagtctctttcctgttttcactctttattctttttctcttctttgctcctcagattggaagatttccagtgatctatctttgagttgactgattatttcttctgcaactgacaaacatttaactaggttagctaagaagcaatgagagaagactcaagtaaaatcagaaatcaaagaggagacattacaactgctaacacagaagtaaagagaattaatttaattatgagactagtataaaaattatacaacaaaaaattggataacctagaacaaaattcatcagataaattcctggaaaaataaaacctttgaagactgaatcatgaataaatcagaaaactgaacagaccaataatgagtaagtagattgaaacaggaataaaaggtctgctatcaaagaaaaacttaggaccaggtggcttcatggctgaattttaccaaacatttgaagaactaataccaatcattctcacactctttcaaaaactaaagagaagtgaatacttccaaaccattttaagagatgagtattatcatgataccaaatccagacaaaaacacaacaataaaaggaagctacaggcaaatatccctgatgaacataggtgcaaaaatactcaacaatatactagtaaactaaactcaacagtacattaaagagataatttactatgtcctctttatattaaagtaatctgtatggcttatgaattacattttaatgtctactttcaaaagattggaatgtactgtatcactctccttattttcttgccatttgacctatgcttatcacttatgtgctttttcttatattttagtaaataatttataggaaaaaaatccactttttactaaaatcaacttcaaaccattaatctcgtttacagaaagccaatttctatgttgacttttatgtgtcagtgtgggtgagctttccattgagaaaacaacaacaatattattcagaataaggaacactctttaatcttaccctctaaaaacaaagataaatgagatagcagataatttagacagtctgaaaaaatttttgtctctaatttaaagttaagattgaccacagcttttatgtgaaatttgatttataaaatattgtggatttgatactcctaataatgctttttacatttgtaaaggacatgcttttatctttttttttttttttttttttttttgaggcgaagtttcgctcttgttgcccaggctggagtgcaatggcgcgatcttggctcactgcaacctccgcatcccgggttcaagcaattctcctgcctcagccttcagagtagctgggataacaggcatgctccaacacgcctggctaatttttgtatttttagtagagatggggtttctccatgttggtctcgaactcccgacctcaggcgatccacctgcctcagcctcccaaagtgctgggattatgggcgtgacccaccatctccagctggacatgctttatattttaataactgattataacactcaatgtagcaaattaatgatttttttctggaaaaaagtataatctatgccacagtctaggcatattttaaagttgactgtatatagctgaacattccaagtaatgagttatacaatgtaacttttcatggtagtaatgttaagattatgtcgtaatgttaagattatgacttgtaatgttaagactagtaatgttaagattatgacttaaaaaatttacattttgagtcaatcagggagttattcacaaaatcaaaattttcaaaaagtttatattttccctttgtagtctccatttttcttattagtcactgaagaacaagagtatttgtcttcttgtgtagttttattatgggcaatatattttccttttttaaaattaaaagaataaagactataataaataacactgagggctggatgtggtggctcatgcttgtaatcctggctctttgggaggccaaaattggcagatcacttgagcccaagagtttgagaccagtctgggcaacatggagaaaaatcatctctacaaaaaaaaaaaaaaaaaaaaaaaaaaggcaaaaacaatttagcctgccatggtggcactcaccagttaataccagctacttcacaggctgaggtgggactttgcttagcctagcaaagtcgagactgtagtgagccgtgatctacttcagcctgggtggcagaataagaccccatttccaaaaaataaaaaaaattaaaattcacactgagtatgtaattccaaatgatttctctcaaagaaatatttctggataaataaatattacagacaaattagctgttcagtataaaaaacagatttttatttagaaataatatgtccccatataagaagtcccataaggtatgttcttctacaaacattatgtcaaaggctacctgtgatctcaaagcatcagcttgaccacctgtcatttatttctcaggttaaatgctgttttatgaagaaatgatgatataagagcaatatgataacatcgtagatcctttcaatgttgttgaaaaatgtgacagaaaaaatattttagattgaattactttacttataataaagaattgagcttctacaaatgcatattaatcagtttttgctaatttaagtgattttgttacttttaagttttaaaaggcagatttatcaacagctctcaaatacttgcttttttctgttatgactactttcttttggtcatcttcatgcatgcttgaagttttaggattcataacatttggaaatgtatcactttaaagaatgagggaagtcacacagtgtaccataattctttttggtgcttcagtgactaatatggtgagtgtttcccagacctccaaggtgcttatttccttgactgggagaagtattgcttgctgctggctttcagccaccagctctgagcaagagtactatccagccaagcttatgccctctctgacatctaatgactgggtcacagggtgagtggtattttatgccatatttactgtacacatttatccacttccttagtgcatatctggctcactgctctgtatttacacctcaatgtgactttatttccagatttaaaacatatttcgagaaagcatacaaaattcaccaactcaggtgaatacacagtttgatagagtttattttagagataaagtttattctaatagctttgaaaatgacttcactcatgtattgtagaatcattaagagtcaaagggattgcttactttttttggttacactttgccgtgttttaggaagcaaattatttgctgtactggtattaagggatttgcaaaaatctcaggatgtagactaataataaaagctgacatttattgagctttacatttattgcatttaatattcataatcatgtaattaggtagacattattatttttaccattttaacagatgggtaaacccgagtttgctaatatttacttgggacttagatctggagcacaaacttaggatattctggtagcaaagactcttctctcaaccactgcttcttaaataatagtgatctgcagaacttaatacacatatgcccataacctcccacatacccacacatggagacagactttcacagtgtgtgtacaagaggggtgtggttatagcaatttggttggaaaattgggcaagctttggaagctttttacagaaagttaagaaacatcaacattctatttaaaagtagagaatataatttggatatgacacagactatggaaagactctggcattattctttgtgtgtgtgtgtgtctgtgtgcgtgcgcgcgcgcattgtgtactcacacacattcaagaatgcccaagtattatggcagagattccaagttacatgggttttagataccactgaactgtaacatcactatatttttcttatgaagtcctctatggccttcatttgctatattttccccaaatttctggtttttccctctctctaatttctagagtttttagtttcctttttaccatgttctcttggtaacatcacaattctcttattacccagattctggtctttaacctaagaattactgagctataatttatataaagtgaaatccccctttaaagtgtccagtttgatggattttggcaatgtgtacaattatataaccatcaccgcaatcaagagacagagttttatgcccctttgcagtacatcttcctgaaaccttggccctttttgtcatcagagtttgaccttcactagaatttcatttaaacagaatcatatagtgtgaagttgtatgtgctagacttcattttaatcataatatttaaatttattcctgttgttgcatgcctcaatatttcattcctttttattgcttagtagcattccatagtatggatatactgtaatttgttcatccattagacaagttatggtcatttgaactgtttctagtatctgactattgtgaataatgattttatgaacattcttggacaattttatgtggacatctgttgtctgttcacagttgtactctgggttaacacacagaagtgggattcccgggtcatactatgttatgttttacttaataagaaactgacttaccattttctaacggaggtgtaccaagtttcactactgttggcaatgtgtgagaattccagttgctccacatcctgaccaaaacagaattgccagtccattaaattttacccattcctgtgaatggatatgttattttactatggatttaattttcatttctttaataattaatgatgttgaacatgttttatgggcttatttgccacttatatgtcttttgtgcccattaaaacttctttgtatatcttcttcttattgacttttatgaattttttatgtactctggaaacaagcaattagtcatgcattttctgcaaatattttctatcagtttgtggcttgtctttttacttccttgtgtctttcaaagagcaaaaggttttaatatgtcacaaaattttctcttatatttcattctagagattttagggttttagctcttcatgtaagcctgtgatccattttaattggctatttaacttttgtgtatggtgtggataagtgttgaggttcctttatttccatgcaaataggcagtatgatttgttgcaaagtctatttctccccattgaattatctttgtaagtttgtcaaaaattgattcataaaagaactatgagtctatttctgaattatattttatgttatgtaaatccaaatgttgattcctatgccagcataacattttgtcatgattacaatggcttttattaagctttaaaatcagggagtgtgagttatcccatcttaccttcttttcaaaattgttttgccttttctaagtcccctctgtctatgtaagtattagaatcctcttgatgattagtacacaacaagcctgctgaggttttgattgggattatgtaaaactgggattaatttttggagaattgacattctaacaaagctaatccattagcatattatctttctccacttatttagatattatttaattttgtgttttataactttaaaagtatgagtttcttaaaaaaagtaattttgacatttattttagattcagggagcacatgttcaggtttgttacatgggcatattgtatgatgctgagtgatatggtttgggtgtgtcctcacccaaatctcatcttgaattctcacatgttatgagagggaccccatggggaggtaattgtatcatgggggcaggcttttcctgtgctgttctcatgatagtgaataagtctcacaagatctgatggttttaaaaaggggagtttccctgcacaatctctcttctcttgtctgctgccatgtcagacatgcctttcaccttctgccatgattgaggccgtgtggaactttaagtccattaaacctctttcttttgtaaattgcccagtctcagatatgtctttatcagcagcatgatgcagtaaattggtaccagtagagtggggcactgctgaaaatatacccaaaaaagtgaaagcaactttggaactgggtaacaggcagaggttgaaacagtttggagggctcagaagaagacagaaaaatgtgagaaagtttggaacttcctaaagacttgtagaatggcttttcccaaaatgctgatagtgatatggacaataaagtccagactaaggtggtcttagacagaaaggaggaactttttgggaactagagcaaagacaactcttgttatgttttagcaaagagactggtgatattttgtacctgctctagagatctgtggaactttgaactcaagagagatgattttgggtatctggcagaagaaatttctaagcagcaaagcattcaagaggtgaattgggtgctgttaaaagcattcagttttataagggaagaagagtataaaagtttgaaaaatttgcagcctgacaatttgatagaaaagaaaatcccattttctgaggagaaattcaagccaattgcagaaatgtgcctagtaatgagaggtttagcatttgttcatcaccaaaacaatggagagaatgtctccagggcatgtcagagacttttgtgtcagcctctcccatcacaggctcagaggactaggagaaaaaaacggtttcatgggctgggcccagggtccctctgctgtgttcagtttagggacttggcaccctgcatcccagcctctccagccatgactaaaagtggcaaacatagagcttgggctgtggcttcagagggtaaaagccccaggccttggcagcttccacatgatattgagtctgtgagtgcacagaagtcaagacccaaggtttggaaacctccacctatatttcacaggatgtgtagaaacacctagatacccaggcagaagtttgccacaggggtggggcccttatggagaatctctcttagggcagaggaagggaaatgtggggttggagccccaacacagagtccctactggggcgcaatctagtggagctgtgagaagagggccatcatcctgcagaccccagaaaggtagatccaccaacatcttgcactgtgtgtctggaaaagctgcagacactcaatgccagcctgtgaaagcagccaagagggggcttataccctgcaaagccatagggacagagctgctcaaggctgtgggagcccacctcttgcatcagtgtgacctgtatgtgagacatggagtcaaaggagatcattttaaagctttaggatttgactgccccactggactttggacttgcatgaggcctgcagcacctttgttttggccaatttctcccatttggaatgggtatatttacccaaggcccatacccccattgtatctaggaagtaactaactagattttgattttacaggctcataggcagaagggacttcccttgtctcaagtgagactttagactgtgaacttttgagttaatggtgaaatgagttaagactttgggggactgttgggaaggcatgattggctttgaaattggtgaggacatgagatttgggaggggtcggggtggaatgacatggtttggctgtgtccccatccaaatctcatcttgaattcccacatgttgtgggagggatccagtgggaggtaattgaatcatgggggcaggtctttcgtgtgctttacttgtgatagtgaataagtctcataagatctgatagttttaaaaaggagattttcccttcccaagctgtcttctcttgtctgctgccaagtgagacatgcctttcaccttctgccatgattatgaggcctccccagccatgtggaactttaagtccattaaacctttcttttgtaaactgcccggtcttgggtatgtctttgtcagcagtgtgaaagcaggctaatacattaaggtttgggttattgatctcattacccaggtagtgagcatattacccactagccagtttttcaacccatggtgccttcccttcctcctgcctagtagctgatagttgtttccatctttacatccatgtatactcaatgtgtagtttccatttataagtgagaaacatgcaatattttattttctgttcttgcatcaattcacttaggattatgggctcaagctgcatccatgttgctacaaatgacatggttttattatttctttatggatgcatagtattccatgatgtgggtgtgtactacatttcctttaaccagtacaccattgaataacactgcaatgaacatgtaagtgcatgtgtctttttggtagaataatttgttttctttgggtatatactcagaaatgggtttgctagattgaatggtagctctcctttaagttctttgagatatctccaaactacattcaacagtgagtgaactaacttgcattcccaccaacaatggttaagccttcccctttttccacagcctcaccagtacctgttattttggtacttttataatagctattatgactggtgtaatatatcacctcattgtttttttgttattgttgcttgttttttcctgagatgggagtcttgctatgttgcccaggctggagtgctgtggtgcaatatcggctcaccgcaacctctacctcctgagttcaagcaattctcctgcctcagcctcccaagtacctgagattacagtgcacaccatcacgtccatctaattttcctatttttagtagagatagggtttcaccatgttggctagcctggtctcgaactcctgacttcgtgatctgcctgcctcagcctcccaaagtgctgcgattacaggcatgatccaccatgcccagccctcactgtggttttgatttgtatttctctgacaattagtgatgatgagcagttttatatgtttattggccatttgtatgtcttcttttaagaagtatctgttcatgttctctgcccatttttctaatggggtttttcttttttgcttgttgaattgtttaaattccttatagattctggatattagaactttgatggatgcatagttcacaaatatttttttcccattctgtaggttctgtttactcttttagtagtttcttacgctgtgcagaagctctttaatttaattaggttccagttgacaatttttgtttttgttgtaattgcttttggggacttattcaaaaactctttgccaaagctagcattgaaaaggatatttcctaaattttctggtaggatttttatagtttgaggtattacatttaaatctttaatccatcttgagtttatttttgtatatgatgattggtaggggtccaactttgttcttctgcttatggatagcgagttattccagcaccatatgttgaacaggatgttcttacctattgcttatttttgtccactctgttgaagatcacctggttgtagatgtacagctatttctgagttctctattctgttccattggttgatgtgtctgtttttgtgtagtaccatgctgttttggttgctttagccttatagtatagtttgaagttgggtagtaggatacctccagctttgttcttcttgcttaggattgctttggctattccacttcatttttggttgcatataaattctagaatagtgtttttctatttctatgaaaaaatgacataggtagtttgacaggaatagcattgaatctgtaaattattttgggtagtgtggccattttaataacattgatttttctaatccatgaacatggaatgtttttccatttatttgtctcatctctgatttctttcatcagtgtttaattctccttgtagagatcttttacatccttggttagctgcattcctaggtatttcattttctttgtggtaactataaatgaggttgtgtttcttattttgactctcagcttgaaccttattggacatagaaatgctactaatttttgtagactgattttgtatcctgagactactgaagttgtttatcagttctaggggccttttggcagtctttagcattttgtaggtatagaatcataatgtcaataaagagagacagttgggcttcctttcctgtttaggtgcatattatttctttctcttgtccaattgctttggctaggacttccagtactatgttgaataggagtggtgagagtgggcttccttgtcttgttccagttctcaagagaaatggtttcagtttttgccaattctgtatgatgttggctgtgggtttgtcatagatggctcttattattttgaagtgtgtgccttcaattcctcgtctgttgggagtttgtatcataatggagaattggattttatccaaagcttttctgtgtctattgagaataattttttcttttaattctgtttatgttgtgaatcacatttattgatttgtgtatgttaaaccagcattgtatcccagaaataaagcctacttacttgatcatggtgtattaactttctcatttactgctggatttggtttgctagtattttgttcagaacttttgtgtctatgttcatcagagatattgacctgaagtttccatttgtgttgtcagtcttcccgattttggtatcaggctgacgctagcttaatataatgagcaggaaggaaactctccttcattttttgtaacagtctcaggaggattggtaccatttcttctttgtacatatggtagaatttggctgtgaatcaatctggtccagggcatttttggttgataggttttttttttttttttttattactgattcaattttgaaattcactattggtctatttaggttttcactttcttcctgattcaatttccagaggttgtatgtttccaggaacttatctatttccactaggttttctaatttgcgtgcattcagttggtcataatagtctctgaggatcttttgtgttttttgggatcagttataatgtcacttttgtcatttctattaaaaattatttttattttttgtgggtacatggtgtatatatttatggagtacatgagatattttaatataggcacaaaatacataataatcatatcagaggtatccatcaggtggggtatgcatcacctcaagtatttattctttctctgtgttacaaaccatccaatccaattatactgttttaattattttaaaatgtacaataaattattgttgactgtggccaccctgttgtgctatgaaagactagattttattcattctatctaactatattttcgtatcctttaaccatcccacatccccccctttcccagcctatgatattcattattctcttctctacctccattgatgcaattgtcttaatttttagcttccacaaataagtgagaacatgtgaagtttgtttttctgtgcctggcttatttcacttaatataatgacttccagttccatccaagttgaaaacgacaggatctcatccttttttatggctgaatagtactccattgtgtccaggtatcacattttctttatccatttttttgttgatggataattagattgcttcaaaatcttgactgttgtgaatagtgctgcaaaaaacatgagatcacagggaatgatggctcatacctgtaaccccagcactttgggaggctaaggtggttaggattgtttgaactttggagtttgagacaagcacaggcaacatagtgagattgtgactctactaaacattaaaaaaatcagccaggcatggtgacgtgtgcctgtagtgccaactactcaggaagctgaggtgagaggatcatttgagcctgggagatcaaagctgcagtgatctcagatcaaggctgcagtgagctgcgatcatgccactgcagcccagcctgggagacaaagcaagacagcatctcaaaacaaataaatacatacatacatacatacatacatacatacataggtatgcagatatctctttgatatgctgacttcctttcttttgggtatatacctaggtgtgggactgctagaaatagaatggtagtttctagttttagtttttattttattttattttttaatttttttcagatggagtctcgctctgttgcccaggctagagtgcagtggcacgatcctggctcactgcaacctctgcctcccaggttcaagtgattctcctgtctcagcctcccaagtagctgggattacaggcacatgccaccatgcccagctaattttttgtattttagtagagatggggtttcaccatgttgcccaggctggtctctaactcctgagctcaggcaatccacccacctcggcctcccaaagtgttaggattacaggcatgagccaccatgcctggctagttttagtttttatactgttctttatagtgcttgtactaatttacaattcccatcaacagtgtacgagggttcccttttctccacatccttgccagcattcagcatttattattgcctctcctttgaataaaagccattttaactgggaaggtaggacagcccattgtagttttgatttgcatttttctgatgaccaatcatgttgagcattttttcatacacctatttgccatgtgtgtatcttcttatgataaatgtctaatccgatcttttgccagttttaaaatcagattattagattctttgctatagaattgttcaagtttcttatatattttggttattaatcccatgtcagatgggtagtttgcaaatattttattccattctgtgggttgtcttttcactttgctgattgtttcctttgctgtgcagaagctttataacttgacattatttcatttgtccattttgcttcggttgtctgtgtttgtggaatattacttgagatctttgcctagaccagcgtcctagatagtttctccaatgctttcctgtagtagttccatggtttatgttcttagatttaaatctttaattcattttgattggtttttgtttatagtgagaagagttcagtttcatttttctgcatatggacatacagttttcccaataccttttattgaagagattgtcctttcccaatgtatgtttttggcatctttataaaaaatgagttcagtgtaggtgtgtgaatttgtttctgggttgtctattctgtttcattggtctatgtgtctgcttttatgccagtaccaggctgttttggttactatagctctgtagtataatttgaagtcaggtaatgtgattccttcaattttgttcttttcactcaggatatctttcactattctgggtcttttgttgtttcatataaattttctgattgctttttctatttttgtgaagaatttaatatgtgttttgatagaaatcacattgaatctatagattgctttaggtagtgtgacattttaacaataatgattcttcccatccatgaacatggaatatctttttcatttttggtgtcctcttaaatttctttcaacaatgttttatagttttcattttagaggtctttcactctttggtaaatttctatgtatttagttttatgtgtggctattgtacatgggattacttttttgatttctgtttcagattgtttactgtcattatatagaaatactacaaaattttgttcattttgcatcctgaaactttactgaatttatcagttctgataatttgggtggtggtagtctttaggtgtttccaaatataagattatatcatctgcaaacaatgataatttgacttcttcctttggaaattggatgccctttatttctttatcttatgtgattgctctgtctacgattcctagtattatgttgaatgacagtggtgaaagtgggcatcctttcatattccagatcttaaaggaaaggatttcagtttttcctcatttaatgtgataccagctgtgtgtctgtcatatatggtttttatttttgtcatttatgattgtacttattcagatattctctctctgacacacactctctctgtctctctctctctctctcttttgttaatctagttagtgctctgccaatcttattcattctgttgaagaaccacccttggtttcattgatatttgtgtggaattttgtgtctcaatattgttcagttcttttccagttttagttatttcttttcttctgctagctttggaattggtctactattttccccctccagttcttctaggtgcattaagttagattgttactttgcaatctttctaacttcttgatgaaggtgtttagttctgtaaacttctcttaacattacttgagctgtgtcccaaagatttggtaagttgtgccctactttcattaatttcaatgaattttttgatttctgccttaattttgttgttcagccagaagttattcaggagcaaatgttcaagttccatgtatttgtgtagttttgagagatcttcttgatattgattctatttttattgcactgttgtaaagagtgtgcttagtatgagttcaattttcttgaatttattgagacttgctttatgactgagcatgtagttgatcttagaatgtgttctgtgtgcagatgagaagaatgtatattatgtgattgttgctgaattattctgtagatatccattttgtccagttgactgagtgtaaattttgagtctagatgttctttcttagttttctgcctcagtgttctgtgtaacactcaggggagtgttgaagtctcccactattattgtgtagctgtctaagtcttttcataggtcaaggataacttgttttattactctgggtgttccaatgttgggtgcatatatgtttagtatagttaagtctttttttttaaaattatacgccttatcgttaggtaatgcccttttttgttctttttaatttttgttggttttaaatctcttttatctgatataataataccaactcctgctatttttgttttagcctgtgagtatcattaaatataacatgggccttttgaagatagcagacagttgggtcttatctttttattcaggttgccactctatgtcttaaatgaagcatttagaccattttcattcagagttagtattgatatacgaaattttgatcctatcatcatgttgttagttggttgttttgtaaatttgattgtgtagtttttttttaagtgtctgtggcctgcgcttaagtgtgtccttgtggtagcaagtgtcattcttctgaatccatgcttaacattcccttaagagcctctcatgaggctgatctagttgttaggaattctcttagactctacttgtctgagaaggattatctctccttcacttatgaaacttactttggcaggatatgaaattcctatttggaatttcttttctttaaggatgctgaaaatagggtcacaatttctggcttgtaaggtctgctgctagtctgattgggtccccttcgtatgtgccttgacccttctctctagatgcctttaagatttttattttcacatttactttggcgaaatctgaaaggcactatatgccttggtgatagtcatcttatatagtacctaccagaggttctctgtatttcttgaatttgcatgtcaacctctttattgaaattatggaaattttcatggaccatgtcttcaaatatattttccaagttgcttactctctctccttctctcttaggaatgccaatgtgttgtaggtttggtctctttatataatccaatatttcttggagattttattcattttttaaaattgttttttctttatttttgtctgagtgcactgacttgaagaaccagtcttcaagctctcagatttttttttttcagcttggtctatttttctgttaatactgctgaatacattatgaacatttttattgaatttttttcaattccagaagagcaatgttgttcttccttaaaatggctttctttcatctcttttatctcatggattgttttactagagtcctgggattgggtttcaactttctcttgaatctcaatgggcttccttttcttcctgattctgaattctatttttgtcatttcagtcatttcagtctggttaagaacaatcgctgggcagctagtgggctcatttggaggtaaggggacattgtagctttttaaattgctagagtttttgtgctgcttatagctcatctgagaaggctggtgttctttactgtggtgtaatttgagtagactcaattgcttcatttctggatgctttcagagggacaaggctctgtatgggatctttatttgtggctggattctagcctttggtatcacaggggtgtgtattaaaagaatatttttggtgttgcagcttgggctgtgatccagtagatgctgttttagagtagtgaccagcagataggctgttattcagccacatggctcttttatatttccttgcattaacagccatgctctttggtggaggaagagagagatgacctcatcactatgtctgctcctgggccttgagggatccctctctgatcactggtgctgtacctgtgcacttcctttgttagatgttctggactacagggctctattgggtagaggtcgtggcagggaggtaggccacaccttttccagcccagcccagtacagggaggcccatcctgctcctgcaccagtcaatgatcctgcatgtttcatccctctcagtactctgacagtggaggctcctccccaactctggtgccatccacaaatctttgctcagcattcccaagatgcctgtcacagccctggggcaatgggatcaggccatagctccatccttcagacccttggagttgagctgcaactgtgctgaggaatctgaagtgatactaggtcactgggaaactactcggggagcaaatcacccaggctggacagcaaagtctgtgatgtgcacaaaaggccctggtagggactggtgggcaggagggcctatagaacagatgtgccacagtccttgggtaagccagccccactgtctcctggccaggtggacagctggggctagagctaattggagagagatgtggaatcctgggggatagggtgcctatgggcacaaaggcctctggctccatctgtctctgcctactctctgggaagattagcctgctatttcaaatgtccatgagggacactggttcccttgtagctagcatccccatggtccacagcaagagtgggttctttctctgtcccttgacccactcttttcccagaatccattcagggctggaaactagctctaacatttgagtaccccagcagggtccccagcttcctttctcttcagcctcaatgtgtgtgtcgcttctccgtcaactctcggtgttttctgtctgaagatctgctcaaagtaggttggttttgttgatattttggtcactctcagtgggagtggcacttcctgccttttgttaagtgccatgaataaaataagccacatgctttgataaagaataataataggagtggaggatataggttgtgtgctacgtatgggtcaaggaagaggcctttttggggctgtgataattaagctggaatctgaagggggacaaagagccctcttcatgaatagcaaaatgaaggaacaacttgtatgaggatctttagatgagaatgcttttagaggcatcaaataactgagaggaggcttataaagcttggtggggatgcaggtggaacaaaataagtttgaagaactaggcaggatttaggtcaagtagggatttgtggacaattgtaggaaacacaatttctggcttaatggatgaggagataagaatacataaatatttatgaaacagaatgggaagttctacagtggaggcagaaaccatgaaccaggggcaggcatgcttttaatttaaacgttaagatagtaaatgtctgttgcaactactcgattctgcattatactgcagaaacagacatggtaaatcaacaagtgagagtggctgtgttcccaacaaactagttacaaaaacagtgagtggctggatatggcccataggccatagattcctgacccctgacataaaccaagagttcttgcctctaattctgactcaggataaaaatcacagagttggaaattcaggtagagttttgaagggtaagaagtgttttagtaaaaagaaaaataaggggattatataccagatagagcaaagcacaaggacattaaagggaatatactattattgctggggtagcaaaactggggcatatttggacagcagtgtgtgtatgggtggtgtgtgtgtgtgtgtgtgtgtgagagagagagagagacagagagtcaaaaacacaatggaatgataaaaatgaaactggtcaggctggcgttctgaaaaacatacaaagacattggacttaactgaaaggcagattcctaaaatatttcattaccatgcttacatttaaatgttgagtgacattcatgtgaaagatgaattggaattggacaacagtagaagtatttttcttgtcaaaaatccccaatggctttctgtttcttgccaaataagtctaaatccctatcgatattaagacctgccatgatttccacttatacccccagtctaattttatttgctctcattttcccaagagagaaagcccctccctaagactgatttccacctggtaatttggcttctgttatctaaaggatcagcttctcctgtttattattttattttttttaataaattcagaaagcatttctagatgtttcctaaggctattttctcccaccctggatctcttccgttgactgtgattcatgttttgggcacctagctatgcaaggtcttatttgtgcttctgttgtatgtttcatatgtctcaccaggattgtaaacttcttgagcagagaaatcattgcttcctataaaaagggcttgttttaatgctgaggatgctgagaattctcaataaacattaattgatgtaaacatcaataacattgaaaattctatctgagcacaaactaatgcaaaactagtttataaacctgatcaatgttttcattaggatttctaaaacattcctcacattgctgtttaatatttatacatcaattatttgtaccttacaatattatagtagcaggctgaatattaagttttacactttctgtttccagtttttaaaatcgacatattttttacctttgggcagaaagaagtgttctgtcttaaatagtgatgaagttatagtgggagaggatattaagcagaatagcaagtgtcacaaagttggtacaatgaaagcacaatgagttcagagtttaaacaactatgtatttactactttagcccatttgggctgctataacaaagtactatagactgggttgcagataaacaatgacaatgtatttattactacagttctggaagctgggaagtccaagactaaagcactggcagatttggtgtctggtgaggaccagctttataattcatagatggtacctttttggttgtgtccttacatgatagaaaaggcaagacatttcttctgtaaggacattaatcccatttataaagattttgccctctgacctaatcatctctagaaagccctaccttctaatcccatcatcttgaagattaggttttagattatttatttggaggggatcacaaacattcagaccatagcaaaatttacagctgaaatacttgttctaggaccctaagttacttgctacctttagaatggagtacatactgtgtaattaacagacatgaacagtgttgtttctttttacctttgtggggattgcagtgccatatttagagaagacagatttaagcagaaaattatgaagactccttttggaacacttaaaaaatttccaaaaatacaagttgaacctcttgagcatcattgctgttttcatcttgctcttcagtcctctagggtgtacactaggaggaagttgtcttctatcattgccttggaaaggtaattagacatgataaatttgtcagtattcacaatcctttgatttggtatttcagacttttagtcctccttgaaaaagattaagccattaatcgccaatggttcctcatttatctgagaaatagtgttcagagaaatatcacctctgaggctgtttacctactggacatgaaatagggcctgtaaaagtggggcacattcactgacttgattacctttcccatggcccaatgtagcagggcttgtaaaaaccacaggagacagcagatgtcttctgatatgacctttattgcagtagccttcaggttcctaaggagttaccactgggaggattaacagtattttccctgcttatttgacttcctgagtcacaaatttccttcagacccagcgggtggctgttcttttagtagggcctaatttttcttggtggaaaggttatgctttccttatagtatgaattctcccctataagaagctcccactatgtgcagctcagagtaaactgggacaatttagtttaacgttccttgttaaacacatttctgtcctttaagtgctgagagtgagcccataatgtactcgggattcctttcttacatgcccatgttatagcacaaaggcaaatacatttcataaaatactggtttgttgcagttgattcttgttacttgcaaccattctggtctacaaagtcattggtgatactaaccattgcccttaaggaaaattcagggttaggtcccttgcagtcacaatgttctcataactacataacctagttttgtgtgtgtttctgttttttttttttaatatatattgctgatttattaacattgaactcacagctggcaacaccataattcatgcctgaattaagtttatgtaatgcatgtactttctccataaggcacatcacggtcttcttgtgctgaggaacactaggtaggacttcagcactatgctagggccatttttacacggtgaaatcaccagcaaaaagcacaaaaaatgcaaaaaaactggcagcaaatagatcttgaaaaggacacttgtttatgagagctgaagaagaaggcacaatgttgtttttttcagcttcagctggggtcctgtgcattgggcaattcaaggtctttcccttctacctatatccacaaatcactgtgaaaacaccttgtgtattgattatggggctacaaataaattttagaaagtaggtgaattcatgaatacagaatctgaaaataatgaggacaactgtatatcactggccccatgtttgattttaaatttatagcactctacatcttttgaatgatttggaaatacatgtttttcgaattgctcaaccctgaaacagatcaaccagatcaaccagtgggtgtgtcccatctagtttttatgcccttccatccacattttacaggtagatttatgtctacaaatgagtcttgccttatgctggaccctcaaagcatcccacaatccacctctgtgtaactgtgttttattggaatgtgattcaatgaactcattataaaatggaaaacgaattcctcatcccatttttgacctttttgcccactatctatgtggactttggtcaattgtaatcacaagagctatctgctatcaatatttaaatgtccatgccattgatatcatcaactttctgaacattctgagttaatgtcagctttcggaagagtgaccgaagggcagggaaggttgacattcacggcttctttttgctttgattttctagctcttttgcctcttctctctcacccaatagctaaggttcttcccctcttggggtccagaaggagagtggattaagagaaaaggcagccttgggctggtaggatctagtgacctggacttgtcctctggttatggtgacttcctatgttacttgttttcttctagggcttctgtgggtttctcagatatttccctactgggaacctccatgcacagttacaataatgtgagcaatgcatctactagctgcagttgttgcttttaaacttcagtcagattttcctaccttgcccatccattccagatagttctcttggctcctggctgattttttcctgaaagaacacccactctgtggtatttaaaaaaaaaaaaaaagtcttttatttcaaagggcagtacttcccaaagtagtttaatctctttccttctgcccttcccccggttgagatcccaccattttgcctttagatttcttaagcacatagcagacactaatcccttatttcctcaaacttcagaggatacatataaaactctaaagtttatcttttgaattccttttcacttggcttgagataaaattggatatttctttcctttttctgcagtggggagaaagctgaaaatagttcagtgatgctcttcaaagcatcagtgttattcctttattaattatagatggacattggcccatggggcagaaccaggggcacagttgcttagcgtgttgcgcccacatattctgcaacattgcaaagcattattttgctggccttagactgaattttatcaatattattttttattttttttcctaggaaaaggtcatgggttctgtatttatcagatattctttaagttcttaatttttggttttccataagtaaagtaataaggcattgatatggttcggctctgtgtccccatccaaatcttgtcttgaattgtaatcctaataatcaccatatgctgagagagggacccaggttggaggtgattggatcatgggggcatttttccccatgatgttctcatgatagtgagttcttaggagatctgatggttttttaaggcaattttccctgttcttgtacactctctgtaggctgtcaccatgtaagatgtgcctcttccccttctgccatgattatgttacttgaggcctccccagccatgtgggactgtgaattaattaaacctattttctttataaattacctagtcttggatgttactttatagcagtgtgagaacagactctaatacaagtatggtctctggaaccagatagcctacatgcaaatgagacttagagcaaattatataatctcattttaccttagttttctcatatgtagttaagtgaataacagaaccttgcttatattattgttgtgaagataacactaaaaaaagcacttagaacaggtttggcccatgataacattaaatgttagatattatgcctgggaatatattctggttgtttgcataattgaatagcatcttagctagatctaagttaattattggatctcactttcattcttttagaactttttaatgttgttccatcatcttatggcatttattgttacattacagatttgatgtcaccctagctatttctctcctttgtaggtaatttgcttttgctacctatatatttgaagaatttttttctttgaagtttatccatataagtagactaggtctcaatattgagcattataaatcaaattttcctgctacctgctgttttttatctattgttttcaatcttcataattaacccttcactttagaaacatttttctacattttatctttgaatatttttcctcttccatttattgaattctcccattgtgaacaaacaattatcattatattggacagtccttgctttctattattctctatcttatgtcttcattctttttttcttaagcctttcatgtgtcattattcattttttacttatgtctgttctgttattgcttttattttatttacatagagatgctgattaggtgattaatttgttttcttaggtctgcagtgtctccatctcattctcttttttatggaatctggtgtcttaggttgtattatagtgtaagttaataagtaggactcttctccagttttttgtgttatattttcttcctggttgaattattcatatttatttaagttttgctttattttttggaagaggatatgtgcctctacactctctagataagttactgtttcttttccttttgaccatgtatgtgcatatcagataaagtagtgtatttgtgctctaatggagcctatgtgactttttggtctttttacgctgtatttgaggccagctgttctttctaatgagctaaagttgaatgagctaaacttcagctaatgagctaaagttgaatatgtgtttatttaattaattcaatcattcatttctgtaatcactcattttttcactttttcaatagcctgggatcatgcataattaaggatgaactcagcagagggaatgctcagtttttttctttgaatatttcaaagtgttttaccttctgagattctttattaatgtctttaactggggttcatttcaattcagttgggaagatatttcccattgtgacatatcacagattttttccctctctgtgtgtttcaatctaatgagtatcaatgaagtgttcactactttaggaagtcacctttgtctttcacttctctgtttaaacttattgttctcagtagtgttttcaaaatgttctttctttcattttttcatttgttgataccactcttggaggctgaagtcagaggtaggaacctcctaaatgtgccattgtacttttctatagaaatgttatttactttaatggaaattcacatacaaatggtttaggctccaagtccttgcctcttttctctcataccttatatctaatctaataggaatcccagctgggaagaccttcaaaacagtgtgtccagaatctaatccaatcacttctttttacctccactgacaaaaatttgggcagggtcaccagcatctctctcatacttcattttcataggcttctaattggtcctggcttttatcctttatcccctatagattgttcttcgcatagtggccagggtggttttttacaacaattaatcagattatatctgtcttctgttccaaagcctaggagagtaaaagccagagtcctttcgatatcccacagtgtggtacatgtttttccctcccacatgacttcacacgtaatactctggcaataacccagcccttcattctattccaggcatgtggtcttcttgctgtttctcaaaaatgcaaaatgtaccatctcctttgcacttactcttactcatgctgaaacctttttttttttttcaaatatcccatgctaagttctcattcaaggttttaatcaaacatcatatgttcagtaaggcctattcttgtcagttgacttaaactttcaacctgttctcccaactctgccttcttcatccctcttacccttatttttttctttttccttatcacttattactaacatacttatgtaatttatttgattatgtttcttgtttatctgtctcctctttctaaaatgtaaattctgtgagctcaagtctctatgtctttcttgttgactgtggtattccaggtgactagaaaagtttctggcatgtattatgtttgtaaaaaaatatttattgactattttaggtaattagtcatttcttccctagaaaagatgataagaaaattatactcgaacaccttttcccttgaagcaatgaccaccagttcatgtccatgaaacttggcagagggcacagttctctttctcttattttcattttggaagaagtccagatctgttggaatgcttgaaaataaaaggaatacttttacagcagagatctgaaaaacaatattaaaaatctcattggttaatattatcttttgtagatatgaagggatatatttaaaacattttgtgattgttccatgttgtatggttcttggtattttaaaatatttgtctcacaggttttaaaaatgaatgataataaattgattaaaaggacagaatgattcctgattttgcaatatcctaaaatacctagattattagaatatgtgattacttgttatttcatcatgatgataataaaagggaggcaggggagcatggaaggaacagtttaagacttgggtaggtcttagcaaaaaatgtcatctgctacttaatcactatatgtgttacccttggcatgttacttaaatattgtgaattttgtcagtccttctttgtcaagtaggagataacaaaactttatcagtcaaatagaaaagcagaaaccactttatcaagaaaagataaatccctttattttattttattttttttaaagagggcgtttaacctagggcattgagaacacaggtactagaggatatgagaagccaaataacaaaaagttagccaacccaaaaattacaacaagaaggacaaagggagaaggaggaaatagcagtctgtgaactagggtcacctgctggctgtggtaacagtgggctggatcacatgggacaaatgtcaactgggagactaaccactgcaggagattgtacctaaggaaaagtgtgggcagaaatactctggattctcctttctcttgtactctagtctcctaccaggacctttgaaaatccagtcctcaccagaagtctgctgacagcaagaaccatagggaaagaacaaggaatgaatctagtaacacacaggtcaagaatcagcaaaaaaaccttcagaattaaacgtgacataccgtatatatatatgaagtgtattactgtgcttttcacatagtgaatatcaatgaactattggtgcaatgatttataaattgctggagaccgcataatttataaacaaaagaggtttaattggctcatagttctgcacagaaaacagagtgccagcatctgctcagcttctggggaggcctcaggaagctttcattcatgggagaaggtgaagtgggagcaggcacttctcatggtgaaggcaggagtaagatgcactcaaagttatagtttgttgatcccctactatatgaaaaccacagtaatgtgcattgtcttttcctttgtgtttgcatggatcaattttaaacacaattttaacctttaaaaacgtgtaacttatttgtaaaatttctcatatgtgtaaatataaacattttatattactcattattgcactcacacccttactttgtcctagtcaattctatttttgcaaattagtatttatctaaaaaaaaaaaaccctgtaattttactctgaaatcacagagcacaaaaatctaagtgcttattttaccaaatataattaaagacaatactgagaatcaatccatatactctaccaacacaagcacaggatagatacgctatctaggagttgtttctggcagaaaaatatcatatgctacaggaaggggtaagaaggaacctaaaactaggttttaggttttaattcgaacaatataatgaattgtcttacatgttatttaagcaagggtgctctttgtaattcataccactctcaagactgagccttttgaaattcaaaccattcattgttgaactttgatactttaaaataccactgaagttaaaaaaatgggtggtgataaaataaaaatctgtttcatttgggcaggcatcacaaaaattgtcttggataattcaaacccaagacacattccaaaatgcaatagtttgctgcatgatttaattcatgtaatataagatacttgaagatttttttttttttaatcgttaagtcttaaatattgaaaaagaaagtctcagcagggcacggtggctcacgcttgtaatcccagcactttgggaggccgaggcgggtggatcatgaggtcaggagatcgagaccatggtgaaacccggtctctactaaaaatataaaaattagccgggcacggtggcgggcgcctgtagtcccagctactctggaggctgaggcaggagaatggcgtgaacccaggaggcagagcttgcggtgagctgagatcacgccactgcactccagcctgggcaacagagcgagactccgtctcaaaaaaaaaaaagtctcaggtcaccaaatctatattttgtgataaggagaagcaaaatttgaaataatttaacttaatatttctcctagttaaaacacagtagaagtcatggttgatagtgtattgactgctgtcactcacatcagaaatgaaacattaattccataattcgtatccatgtttttgcacttctgcttgcctatttattaagaaatatatatatttcttttgacctaggaattcagtaggattatcatgtgaaaaattgtgccagacatgttaaacaggcaaggaagactttattaaagattattgcaacaaaggaaagaaattgaactcaagtctattgaaacaaaaagtaggagagtttttaagttctgaggtgagctactggaaaaggactaaaggtcattagggatgagggcctgtgtgattacgctatctgtgtttgctaattggtgcttatggaagagcctgggagatggggtgctctatctttcctgatgaatgtaattcaaagggatcactcccaggtgtttgaaaaatacatttctgggttgtaaaactgaaagaggctgggagaagatttgtatctcagggggcagagaaaggatttatggttgcaagttttctagagtaaatgctctaagaaaagggaggaaacatgtctaaaattcagtcatgctgaggaacattgaggccatcttggtcaacagattctacaggcaccattttggagttgagatgtacattaaaggaaagatggagcaagcatctcttttccctaaattctgctggtttctgattgaccatttttactttttcactctaaatcgggggaaaaaagtgtcctcctctcctaaggtctctctcttctctgtcccttcagcccttactttagttctaggtgacctttatggaaggtgataatatttccaaaacagaaggcatcacttgccccaatttcctataattataacaagtataaaataaattaaccaagaaaaggatgtattaggccatttttgcattactataaagaagtacctgagactgggtaatttataaagaaaagaggtttaattggcttatagttctgcaggctatacaggaaacatagtgccagcatctgctcagcttttggggaggcctcatgaagcttttatttatgaaggaaggtgaagtgggagtaggcactcctcatggtcaaagcaggagtgagagagtagggggtaagagaggtaggtgccacacactttaaagaccagatctcacaagaactcaccaggtatcatgaagcagcaccataccaggcctcacttccggcattagagattacaattcaacatgagatctgggcagggacagatactcaaaccatatcagatgacaactcctcctctttaatctcctcctcttcctgccttgaatgtttctctccataatgtaagttaatatttatctaaggtaagataaagctatttaaacattatgactttcttatgttagtacgtaattgaacattgtacaataaaacttcttattggccgggtgccgcggctcacgcctgtaatcccaggactttgggaggccaagataggtggatcacctgaggtcaggatttcaagaccagcctggccaacatggcaaaactctgtctctactaaaaatacaaaaattagccaggcgtggtggtgggcgcctgtaatcctagctacttgggaggctgaggcaggagaatctcttgaacccaggaggcggaggttgcagtgaaccaagatcacgccattgcattccagcctgggtgacaagagtgaaactccatctcagaaaaaaaaaaaaaaaatttaaaacttattactgattttcctaaatgtattttccccatttattttcaccttttcatactgtagagaatgccaaaatattaatctcattggagatttgatcctcaacaaactataagatatttacagtacttaaaaaatccataagctcttatttttattttttttaacttgtgcatacctttgtattatgtgatccattttccattggtttatattttatctttcagatgtaaaaagtatattttgagccctcagtgctatgttttagcagctgaagtatgaactttgccctttttgaactggtaattctattttttttcccactaagataagttttctttgtttctttcctatgttactgatggtatttcatcacctgaataaatgcttcccatcttgattttaattttctttcagcagatgaaattaagtcacttactatacttcagtggaattagaacacttttattacagacaaatgtattttagataacattcttaaagttttccttaaaaatttacaaaagaatgtttagatttctgttgagatgtttgtcatacattaatatttgtttttactaaatttactatgtatttattaaattttcaaacatctagataagaagttgagcagattgatttactgttttttgtcctttataggacattgctcacaagatcattaaatgactccaaaaacgtaattcatgtatgggtaattataagtgatacttgaggtgagggataaaaaaagaactagtcctaacaaattaatatttttgtctgcatgctcatattgttttcatacggattttaaaattactctggtttgacattttacattgaagttttggaattttatctatactgactacttctatgaaattgagatatttctcttaccaaatactggtttgcaatgtatatcattaatttattgttttttccagtgccaattcagggctaatataatgggtggctattaagtcctacatgtgttctgaggttctctcagttgtttttaacgtaatctttatctgaatctatttacattagtttctaagcatatgctttagtgttctgtaagttttatgggttctttgttacatgcttaatttagttttagaagcactaaatatgggaatctggaagtgaatatcacagtactgattttctcagatgttttacacagtaattactcttcttaactataacctttgcattttttggccggggtgggtcttagaagtcctttctgcagaatttatccagtaaaagttagtttttggatagcctggggtttacttttaatgcatgtctgaatgctcagttttgataagtcaaatatatccttgcatctaagtccctgctgagtgaaaggttttgctacagctaaaagtctgagaagaaaagcagaaatcatcagggagttagcttgatgcatgaaagacccacaggaaacaaaactgagttgatgttaccaataggagcaattaagaaagaatggttttgtgccagaatgttcctgtaagcttatttgaggaatcactatttctttcttttaccaaacaacctttgttcatcttccttataaataaaacattctattcatattgctaaaaaaagtagtttgcttgggtacaaaaaaggagttttttgctcacattttgaataaacttagatactttcttattcagtctgataatctttgtcttttcattgtgacatttattcagtttattatttaatataattataatttgggttgaaatttttcatataactattggttttttatttgaactaccattattgttcttttttactttaccattttcttggtttctttcctgatcattttctggcgagctacatatttttttatttccccagaaattactaaatatctctttaatttactagagtctatgataaattagtgcctttatacttctagaaaattataataagcttaaaatagtttaatgcctttcaattctctttgccttctgctctttttctgccatttaatttaattctacatatattttcacactcccaaaccattattttttattttattttatttttatttttttgagacagaatctcactctgtcgcccaggctggagtgcagtggagtgatctcagctcactgcaacctctgccttctgggttcaagggattcttctgcctcagcctcccgagtaactgagactacaggcacgtgccacaacacccggctaattttttttatttttagtagagatggggtttcaccatgttagccaggatggtctcaatctcctgacctcatgatctgcccacctcagcctctcaaagtgtgctgggtttacaggcatgagccaccacacctggccccccaaaacattattactattgttttatacagttactattcatttaaattcacccatacatttaccctttcttgtactcttcatttcctcctgcatttctatgacttaatatgaggtcagttttcttctgccggaagaacttttagtatttctttatagctcacatcttctggtgacaaattctcttggcttttgtttatcttaagcatcttcattttatctttatttctagaggatataagagaattctaagatgcaataattttgttaagttctttaaagatgtcagcctaccatcttcaggtggcctttgctgctgcttctctttcttctcttcctcctgttcctcatccttcttttgtcttctttttttgaaatgtcacctaatagttttatttggctgtttgaagggaatatcctctcctacctctgtggctacttttaggtttttctccttatctttaatttttggaattatttttttcccaaaatttgttgtttcttgatccttcaagttaataaaattcaatgaagttacagcttgtggtctttcattagttttggggaagaaaaccagacataggcttctcaaatattcttcctacctttttccccccacttcccttggtacttcaaatgcatgtgttagatgtatagacaatggttcatgtgttcctgacacgatttttttttcttattctttcatctctccaagcttcagtctgacattggtctgtcttccaattttctaatgctttgttttatatctaatatgtggttaaatccatctactaggttctttttttctgtgcttgtatttttatttctagattttatattttactctttaaaaaaatgaactccatgccaggcatggtggctcatgcctgtaatgccagcactttgggattccaggcgggtggatcacctgaggtcaggagttcaagactagacttgccaacatggtgaaaccctatctctactaaaaatacaaaaatccaggcctgatggtacatgcctgtaatcccagctagttaggaggctgaggcaggagaattgcttgaacctgggaggcagaggttacagtgagccgtgatcacgccactacactgcagcctgggcaacagagcgaaactctgtctcaaaaatggaaaacaaaaaactcccattctgtgataaaattctccatgttttcacttgttttcttgaacactgaaaacatttttttttaaattgatatctgaaacttccaatgtctgatttccttgtaggtgtgtttctagtccagatttttttctttatatttgatgacttgttttcttctcctactagtatttattagtaaattggacattgagtgtgaaatgttatagagattctggatgatggtatcttcctttggagaggatttaattcttttctggcagagagaatggaaacatgttatcttgttgcaatcatagttggagaatctatggctcattgagcctttctagggtcttgctctgtttattttgtccctaaagtgtacttttgtagggttttcagtttaaaaaaatggatgtttattagagtttggtttttttttttttttcagtccctaaatcccaatatttactctcacagcactgtgcaactaaagaattctctgcttagattgtatcctcttaggtttattttctgcttgactctttggcctccaccctcgtgtagcttattaatcatcaaatgccttgaggggaaaagtggcaaagaccatttgggttgcctctgttagtttccacttggcagcattttgacccattgtctatcttggttgtgtttgatacattcaaaatattgtcttttgtttatttgttcttgttgaaaaatcataaaagttggataattttattttttcttgttttggaggtaggggtgtggggctgttatctgagacaagccactttatcataagcaggaacataagtacttattaaaatcttcatctaaaaatgttgtaaaaaaatctttataaatgaattaaatctttattttattctcatttgaataataaaaagcattttaatttaagaaaaacattatatagaaagaacacattttcttcttttctactttaggagttttaagattagatattgtcagtttgttacagtacactaatttaaaaaacaaacatgaggctcatattgtttttatggaagactaattgaaactctggagaagataaacaaaaatattagaagaatagctccgataattgatactaagaataattttacatggaataatttgtgcttgaagggggaaaacagattaattggagtttaagagctaaagaacatctgggaactttgttttgtataaatacaaaacaatttacatttttatacaaaacacagaaaatcctactataaataaaatgatgaaggtgaaattctctaggggacatgtagctctgttgtaggacaagttcattgtggtttgaatttataagttagaaagaactagaaagtcactaagtgaacactgaaaaatggcttctttaagagccgataaatgagtaggaaatttttgtccatttgatagtagaggtcattaggtcattggttgcagaaatgttggcaattttgttggttgtacttgtggttgttgattattgtgggagcagggttgaagactaagctctgattttttatcttacccaaattcctgcctaagaggtctagggagtcatgccccacaaaccacaaattctcatcagatgggttttatttaaccctatatattttgacttacttttgaacctaactctagcataatattatgagacaaggaaaaaaatatttaacccaaaatatatttccttaccataccttaacattgccctgcaaagtctctggtgggaagaatccacattctatagagaaacccctaccccttttgttttccggccttccttcccagatccaggaaataatcaactaagagccagtcacccttttaagtcctataaaaaacaatttacaacctgctgtctctaaagtctgctatctaagagcttcctctgaacaataaaacttggtctccacagtcctttacctttaacctgaacattcctttctatcaataccaggtcttcagacaacttcaaccaattgtcaaccagaaaatgttcaaatttacctatagcctggaagcccccactttgagttgtcctgcctttccaaaccaaaccagtgtatttcttaaatgtatttgattgataactcatgcatcctaaaatacataaaaccaagctgtaccccaatcaccctgggcacatgttctcaggacctcctgagggctatgtcataggccatggtcactcatatttggctcagaataaattccttcaaatattttacagagtttgactctttttgtcaacaatataaagagaggctggcgcctaatgtgcggcctcagagaagactcaagaccccaaaggagttgactgaaagtggagctaaggtacaagcaggggcccattgaagccccactgaattcaagctcctcctccagtagaactggtaagtccttctgaccccaggacctcccttaggttaaacgtccttgatttattctaagctggttttccctaggaagttgttgttaaaggatcctaatgcaagtttggaggtgcatttctaaagggtcttctcaattgcttttctctcagaattaactaagaataaggagaaaacaagtagaatgacccccttttgagcacttctcaaaaggggttctcaaaagaggtttatggcacctccacttgaagtaatatggtctttgtgcacagtttactttcagaaaaaaagtcctagggttgacctgcaaactgtagagtttctattctaagttatctttctctattttcttttctgcttgctttaaatctgctgttacttttctactgagattaaaaaaaataataataaccgctgtttggatctaacagtttttttttctttgttttgttttgttttttgttttttgttttttttttgcaagccagaaaatttatattcatctcatggctaaagtactaaagtaaagctataggatctttgtgtttgtatgtgtatgtatgtatatatgcatgtgtatatttaaaggcctttataaattctataatgttatgtttaattggcagttaaatgttttaatttccctctggcacaccgaactttttctccttataccttatcatgtaaattttgctatctaatcttcacctgagttatttcctttaatatgcaaatttggggctatttagctaactactgcctagggtgatgcaacatattatcaaaaatataaaagtctaaaataaaaaaaaaaggaaaacaaaagtcttttctaaatctataaaatacttgtatcagaatgcctaattacatctacatgtttatgtgtgtgtatacaatattttcactactaaaaatatatgaagagctctaatcaactggctttaaaaaagcactcaaatcaaatacagaaaacaaaaaaaaaccagaagagtagtcaaatgttttttcaagttcatgtgacttaagtaaaatctttactaaataaaccagcattaaaattatcagtaaataatatcagcaatgtctttagaattgttagcagttttttttttttgcatctgttgatcaagtagtttaatgtttattcctgtagaatactataagatttgccataagagttataaacgataaaacccagcccaagacagaatgatctttgcttgtatatgcttataaaatattgttggcttaaatgaaaacaactgcatactgagttattggtataaatacccttaaaactaaccataagctttattactaaagtaaatatctgaaattcacagctataaaaagggtttatagaaaaatatattaaatatttgctatcacagttttttgtaaataatctaggtaaactacaagattaattgggtaagtgtaatgaaataaaatcttgtaaacaaacttgtcataatttaggatctaaggttattatttgatataagtatctgggtaatttgtaatttaaaaattataggaatacttttttaacattcttattagaggtaaaatatctttgtctaatccaaaccttatttaagtgttaggtttaaaacaaggtaaaaaaaaaaaatcaggaaataatagatgcaaagaaagttaaagatgtagaaagatatttttggtaaagaatgtaaaaagaaaaattattttatacaaaaaagaatcttgtatggtgaatttttgccctaaaataaaataactgcgttgttcaaggaagaaagatatttggggtaaaacaaaaagtctaaccattgtgaatgatctatgtaagtcataataaggttagtaaaatgaatttataaggggcttgtgtaattcagttggctataattaaaaagaaatcataatctttctagaaattgatatttaatactaaaaaacgtacatgaatacaaaactaaataattggttaaaacaagattttattacaaatattgactttttgtgggggagggggcgaacggagtcttgctgtgttgcccaggctggaggctggagtgcagtggcacgatcttggctcactgcaagctccacctcccaggttcatgccattctcttgcatcagcctcccgagtagctggtactacaggcacctgctaccatgcccagctaacttttttttgtatttttagtagagacagggtttcatcgtgttagtcaggatggtctccgtctcctgaccttgtgatctgcctgcctcagcctcccaaagtgctggaattacaggcgtgatccatcatgcccagcgaaatactggcttatttttaatgcaaaaagtttttaagtttttaaattctataatctgtttaacatttttcagattgagatctttaaagcactactctcttttaaaaaagtcttaaatgatgactttctccttcaccttttgttggctcctgtaacttttactaatctaagggaaaaaaattgtttttgaaaacaggcaaatatagcatattttagacatgccttttggctcacgcctgtaatcccagcactttgggaggccgaggcgggtggatcacttcaggtcaggagtttgagacacagactaaccaacatggtgaaaccccatctctactaacagtacaaaaattagactggtgtggtggtgggtacctgtaatctcagctacttggaaggctgaggtaggagaattgcttgaacccaggaggcagaggttgcagcaagctgagattgtaacactgcacttagcctgggaaatagtgagaatccgtctcaaaaaaaaaaaaaaaaaaaaaaaaagccttttattctgcatagctgttatacctctatctttatatgtatcacgtggaagtaatatttcactttcaaactaaataaaatagctctaatcaaataacttaaaaatgtaagtgcttatcagattggcaaaagctagctcagatgcctcttaatttatataaccttagtaatctttattaaaaattaatttggtacatttaatctcaaaactctccagtaatttaaaattcttaaagtcatgtttaaaccttcaggatttttcgcaccactggaaatttgggttactaaaaagttaaaataataaaagcataaaataagcttttgttaaaattttattaaaattttataaaatacaaggatgtcaattttcaataaatgtaaggtttttggttaagaaactgtttaaaacttgctttaaaataaaggaaattatacagataaaattaaatgaaaaaaaaaaaaaactatctagggcaacaacaccctaagccctatggttatcaagaaaatagttgatatagggaaagggcaaaaccatgtaactatttaaaaaccaaagggtgtaatgttaaggaattgtttcattttgtagattagtatcattcagcttctttaaaaaaaactttagtggattgtagaaataactactttaaaaacaaaattcttaatttcaaatgcttcaaaatgtaagcccttgtttgaattaatgcaggacccacagctcattagtgaacaatcactgatgcacaggaagctattcctaaaaaagcaatcagcctagtaggccagataatgcccattataaggtctgtttgccctgagaaggggattgcccaacgctccctataaaataccaagtaaagtaccccagatgaagcagttgacatgtttcatatgcaagacatgttggactagctttatgataactgggatatcctcccacctaatacgtctgttacccacgtcatggtaaatgtgggggttaaaggggccccttttacatgggtacccctcccacagaatcataggtttatttaagaagccttatcaaatctgctatcccccataggtcatacagatgcaaccccctgctgggaaccccgacccttttcaccagaaaaggtaaaattggtctgggggtaaaacggctttctggaaccagagcacaaaaacatacaggttaatagaattataaaatgtaagatgtttaaacaagatttatgtaagttagtcataaccacttttacttaaatgccttataaaaataggtactatatctaactgggaatgttttcccctttctaatactataaaaccaaagacatgtaaatctgctcatgtaaattctccgctgcatagccttttgtgtggagcatttattggggctaatggcaaaaaccgtaagtatttttcggtaacaatgactgagctagagaatttctacttgatggggcatttactgctttgctatggaatattaactaaagctatccctatattaatggaagtaatgtttcccaaaaagttccataataaaataaaaatggtttacatgaaatcttgctacctgataagcaaaaagcctcttttctaaaactaattgtaaggagttgctaaactccagtgcctaatagctctcgtgagctgtttggtctgtaaatggcatttccaaggtaaacaaacatctcgtttcaaaagctgctgctctggttaaagaaggattaaaatatatgtatatatattttcttttatttggggaaagtatgtttttataggcaaatttccctttctaagtcctccagaattcagattgtagttttatggcaatatagttgtctgcataagttcaataataattttttaaaaaacaaaggcactcgttattttataaagactgaaactaaaataacctatttttaggtaaagtttcagtaaaaccaactttaaaaaaattctggccgggaacagtggctcacgcctataatcccagcactttgggaggctgaggcaggcagatcacctgaggtcaggagttcaagaccagcctgaccaacatggagaaaccccatctctactgaaaatgcaaaattagccaggcatggtggcgcatgcctgtaatcccagctactcgggaggctgaggcagaagaatcgcttgaacctgggaagcagaggttgtggtgagccaagattgtgccattgcactccagcctgggcaacgagagcaaaactgtgtctcaaaaacaaaacaaaaaacaaaacaaaaaaattgttgcaaatcaatttcttactacattttatacaaataatcaggcaaacataataagcctaaaacttaccttgcacacaaattgaccttgctataatattctctttaataaaaaaggtggctaaaaaaaattgtttcaaaggcaaagcataacacttaatactggatttcagccttaactttttttaagtacaaattaaatcattatttcttggcataataatcctctaaaaagtactacattataatttttcttcatatttttagttggtaccctaaaggagtaggttccttttcctggtctaacatacaaattactattatagctgtcaaactataaatgttatttatctctttttgttttacttccaaaaaaaccaagatcatggtattctaaagaccagagatacaaatctccctcatttggcatcctactgggcccagatctgttccactgctaatgctctgttgctaaaactatacaagccgcctccctctaggcccagggactattgcagaagaggtaggcacgtaagattgtaagggccagttttaagggataaaattaaaacaaaatcaaaccctccaaatcaaaaagggggtactaaaaatgcctaaaccgctggtaaaacaatttggttgccttttaaactgttatgtgtcacttttgcatccaccccaaccataaaaattttctgcttactataaaattaaaggaaaatatttactaacaggataaaataccttgtaacaaagtctcctgggtataatactcccaattatgagttgtaaaaataaatctatctatatatatttaatttttcagaacagtgcttatgtttgtatggctaattgctgtaagtctgtaacaaaaaccaagctcacacacaacagctcaacacataaaagttaaaacaagtcagtcttacagcttttccttttggtttttctatctgcctttttacttaaaacaatagtttaaaaaagtcacaaatgcctgtccacatccatttttatctggcctaaaacaattaattggctataagtcttttaactcttaaggccctcagctataggaagtcctgccaagaaaaaaatgacactgtagatttatataactttccctgtaacaaaaccttttctctcccaaataccagtatatggtgcaatacaaaagtggggagaaaaatagatttgtctattgttaacaagtctataacaatttaaacaccaagaaccaggcatttcttgcatttaatttataccctcctcaggatgctatatctataaagataaattagccagaggaaaagattaaatttggctgggtgcggtggctcacacttgtcatcccagcactttgggaggccgaggtgggcggatcacctaacgtcgggagttcgagaccagcctggccagcatagtgaaaccctgtctctactaaaaatacaaaaattagccggatgtggtggcaggcacctgtaatcccagctactcgggaagctgaggcaggagaatcgcttgaacccaggaggcagaggttgcagtgagccgagattgcgccactgtcacttcagtctgggcaacagagtgagactccatctcaaaaaaagaaaagattacatttattaaattctaatttaatgttggtcctacaattctcaagtaagatttatcaaaagatccaaataacccttaataaggaagggaaacacattgtaagtctaatcaaaaatataataatgcatatgggttttttctggctcattagtttgtttattgccctctatttctacctgtaaccttggatgcccaaaccttcactatctttatcatattactatattaacattaaacattttcttgtaaatgttatgccaaatgcagcagaagaaaaggcacgattaaagactcgaatcataatagctcaaaaaatctgatctaggattttttttttaaacaaaccctaggcctgactccatctcaccccttaaacaattggctattacatcacatcagaccatgtcctcccccattattcaaatcactaatatttaaaactattaccaccaatcagactacatgggaataagcattcctagtgccatgaaacctcaccaaatgaccaaatcaaacacccctaggaataagcctcctagtgctgtgggaaccgatgctgtttagttggcctgcaggtgcattctgtggaaagctttttggccaagagtggggactaaggactaagctcttattttttttatcttacccaaattcctacctaaggggtctatggagtcatgtcctacaaaccataaattctcatcagatgggttttatttaaccctatatattgtgacttacttttcaatctaactctggcataacattatgagacagggaaaaaaaatgtttaaccccaaaatatatttccttgccataccttaaaattgccctgcaaagtcacttgtggaaagaatccacattctatagagaatccccttgcccctttgttttatttccttccttctcagatccaggagataatcaactaagagctagacatgatttaagtccaatgaaaaaccatttacaacctgttatctctaaagtctgctatccaaaaagcttcctctgcacaataaaacttggcctccacaatcctttatctttaacctgaacattcctctctatccatcccagatcttcagacaacctcaaccaattgtcaaccagaaaatgttcaaatttccctatagcctggaagcccctgcttttgagttgtcccgcctttctaaaccaaaccagtgtatttcttaaatgtatttgattaatgtctcatgcatcctaaaatacataaaccaagctgtaacccaatcaccttgggcacgtgttctcaagacctcctgacggctatgtcatgggccatggtcactcatatttggttcagaataaatctcttcaaatattttagagtttcactcttttcatcaataatgttaaatattttttttttattctgaccaagtacttgtataaatgtttgttcagtaaattttctcattgtctgggaatacttttgtagcaattctattatcctattatatttcagtgcattgttcataccatatagatacaagaaatgtgtatgaataataagatgctatttgggagcaatctttcttccaaatttgaactaatttgaactactgacatacattttagttttttagtattctgttggctacatttgcttatcaaaggttaaaatttggattcattgatttataccagtagttctcagctatggactaagtgcctccaaggcacatttcacaatacctggagacactttttcttgtttgcacaaaggagaagttcccattgacacttgtagggtagaggccagatgctgttttatacttcaaagtgcacaggggagcccattacaacaaagctttatcctgcccaaaatgtcagttatgtcagggttgaggaactctgatctaaagataaaaataatatgaataaaaatgtaaagaaaatacacataaatgcagttactcaaattagtaggcattatgagtgtctagtatttaccagatttgtgcttattcaaaggtgaatgtagatctatgtgagagataaaacacacaaatatacatttttaatagataagtatttttatgaaaaataatttatttatatcagaaatgacagtaacagataggcgaggaatttgtgcatgtaaatagcatacccatgtttgaacttacagattaagcataaaatgcatctcatggaatgtcttgggtggagatgaatagaggcctgcatcacgggtagtaaaagaatttactgaaacagcagtgagttaaataaagcaagtttattagagagaaagtactttgcaaggaagcaacgggcaacacagcggagaagggaatgtctgcaaagaggcaggggctggaggaaagttttacagggtcatggtgctaggactacttgcatggagtgaggcatttgggaacaggatattgtgccactgggttttttgtggttagctgtctccaaacaattgttctcccctccctggggcccctctttgttgttaagttatcaggactccacatgaaatatttagcagtcatctgtaatacaatttactgtggagaactgtgaaatgggaaggttatatttttctgttggtgaaaagagaaataggagattgcttcaaaatggggtagcctaccataaagaaatgaaaatactggaagctttatgctttcaagtgtgtgcttgacacttcagatgaccttgattacattttgtttactctgcccttaaatttattaaatctacaaatttccaattgcgtacacatttatactttagcttttctgtaaccactattactgaaaccatggtaatgaaatcatctttgttagaattctgtagattgtcaaataaacttcagaaaaagtgagtctaattgcaagttgattctcaaatatcaactgataatggttgctggaagcattttaatattttattagatggagacagtttgaaatttaaagacaacttgaacttgcttgcttgaagtcacaaaatttgcattccaaatttgaaagaatggaggtaagaaaggaggcagtttaggaagagaacactatcatgaacccaggtgctttcaactatcatagtatttaaaccttactgtaactattttaagtggatattattatcatcattatataaaaggaaatgagactaattgttctcagtgtccagctcctaactagggaggtagcttgaattcagttcctttgaaatgaaagttactggtctttcctcatatgctccttctttttgacagaatttatactaatgttcatgacttcattgaatctattttgcatgagtgattttgctgaaggtaacagatgaaaaatacacacacattgctgatgaggggctcctaaagcagacttgatgaatccataagatggaacacagttaacaagttaagaataaacatagaatattccattaaaatatacctttaaatttgaaatatgtaaaataataatctagtgtaattagataatttaaaacctctatttttattttatttacctcggtgaggcttttggaatctgaaaaatgtatcacatccaaatagtattttacattttgactttttgcattatttccttatctgtagagaccacatccaaatagtattttacattttgactttttgcattatttccttatctgtagagacccttaatactactaatttttccaaatgtataattatgtcatatatttctttaagtcaaattttaattcaagtatcaaattatcattttaaccagctcttccttgtgttcctggatacccatcaggcttaatcacactgagttagaatccctaaccactatcttaatgagtgaacctgctttgttagtgtggctggatgtcttggcttgccagaaaaccttggctttatcattttaaaagtttgttctgacttcttagaaagtgttatttgagttacatggtttgattgtttattaaaacagtattataaatgcagtttagcttcaaattatacattttatttgtgttaaagactagaatacctctgactcatttcgtattgaaagagacctagccggccaggcgtggtggctcatgcctgtaatcccagaactttgggaggccgaggcgggtggatcacgaggtctggagatcaagaccatcctggctaacacggtgaaaccccgtctctactaaaaattaaaaaaaaattagcctgacctggtggcaggcacctgtaatctcagatacttgggaggctgaggcaggagaatggtgtgaacccaggaggcagtgcttgcagtgagccgagatcacaccactgcactccagcctgggtgacagagcgagactccatctcaaaaaaaaagaaaaaaaaaaaaaaaagctatccaggaatcattagagtttacaaaatatagggatttttaaaatttattttattttatttatttttataatttattttatttatcttttgagagggagtctcactgtgtctcccaggctggagtgcagtggcatgatcttggctcactgcaacctttgcctcccaggttgaagccaattctcatgcctcagcctcccaagtagctgggattacagatgtgtgccaccatgcctggctaattttttatatttttggtagagactgggtttcaccatattggccaggctggtctcaaactcctgacctcaaatgatccacccacctcggcctcccaaactgctgggattataggcatgagccaccacacccagccaggaataactttttagagtaaaaaaaagtaattgattatttttggtttttgtagaagtaataagacattttgatactttcaacttcatttattttctgtgttgttttaaagacttcttctcctagataacgagataattttgtaactttgctgattctgcatcagttgccatggtttttgattggtgctttactacctaagactgtacaaataacaataatcccaagaaactgttttttgagaataaaattttattaattaaatgctcaagttaaagcatttaaaaataactttcctgagtgcatagaaactgactaagaatcagacaaagaggctaacatctttctgtgtatattaggccaaattgttgggtgagatgaatgaaattcagaataaggaggattgagaggtgaagccagctgggcgtctgggtagggtggggacttggagaacttttgtgtctagctaaaggattgtaaatgcaccaatcagcgctctgtgtctaaaggattgtaaacgcaccaatcagcactccgtaaaatggaccaatcagcactctgtaaaatggaccaatcagcgctctgtaaaatggaccaatccccaggatgtgggtggggccaaataagggaataaaagctggccaccccagccagctggggcaacctgggtccccttccactctgtggaagggttgttcttttgcttttcacaataaatcttgctgctgctcactctttgggtccacacaacctttgtgagctataacactctctgcgaaggtctgtggctttactcctgaagtcaggaagacaacaaacccagtgagtggaacaaacaactccggacaggtaacctttaagagctgtaacactcactgtgaagatctgcagctttactcttgaaatcagcgagaccgcgaacccaccaggtggaacaaacaagtctggatatgccacctgtaagagctgtaacactcactgtgaaggtctgtggctttactcctgaagtcagcaagacaacgaacccagtgggtggaacagacaactccggacaggcaacctttaagagctgtaacactcactgtgaagaagatctgcggcttcactcctgaggtcggtgagaccacgaacccaccggaaggaagaaactccggacacaccatctttaagaactgtaatactcaccacgactgtctgcggcttcattcttgaagtcagcgagaccaagaacccaccggaaggaaccaattcaggacacaggatgaattgatgaggatggaggaaagggaaatagttcaactctgtgagctcatgttataactgatatgttttcttctacaggaaacattttctaaattctctaagaggaatgccattatgttttaaaataggtttatgggatgttaacttttttcttccaaatcaccttctatttaaggtcaaatgttttgcttattttttgaattagaagaaataaatgccacagaagcattctttttaaaaggttcttttcaatagcatacaaatcaaagagatctacctatactgtattaatgggaggaccaaattctgtctttatactgatagctaccttataatcagtagagctaaaatggttgtgactgaagagtttttcttttcttttctctccgtttctccccttttcctccctgctcctttcttccttcccttcttgcttccttcccttctccctccctccctctctccctccctcccttcttccctttctttcctattgctaagaatacaaagaacccctgcttattaaaagttactttgagggaaaaatgtgatatttctattcttaaaaaaagtaggtaagcaaaatctattctaaattctgcctaatcttcagattattggtttatatttcaaaataaaatatgggaatattttatgattttctcttctctttttaaaaaataactagtcattttatattagaacaaaaattcaccaaacaagatcctttctctaaaaaaattttcttttctttataaccttccttatcaaaaatacatctttgttttcataacttccttcaaatctctttcccgtacttactagttccttactaccttgtttcataaataaccttttcaagctgataatttgaattatacgtaggtatttttcccaataactcaggaagttcagcaaacaacattaaattagtctcatttgtcagagaagacacacaaaccaagatcatttcattttggctgggtttctatgccaaaccttgacacctcaaaatatccagcaaagacaaacataacacccggacaaaaatgtatgctgacagttctgaagaagtttctatttttattgtatcaataattttaaagccaccttgtttgttaaaaatttccttaagtcatgtgaacttgaaaaatactttgggcttaacttatgagtgctttttttttaataagccaatttggtaaacgcaatatataacataataaatgtacgtacataaatacttctgatagtaatacaaactcaccagtttagaggctacttttgtttgctcaataggtaatgcaatgaagactgtgaaccaacattttgggtaaaacagctcccatggcagttttatttttatttttatttatttatttattttgagatggaatcttgctctgttgccaggctggagtgcagtggcgtgatctcggctcactgcaaccaccgtctcctgggttcaagtgattttcctgcctcagcctcctgagtagctggaactacaggcctgcaccaccatgcccagctaatttttatatttttagtagagatggggtttcaccatgttgaccaggatggtcttgatctattgacctcgtgagctgtccgcctcggcctcccaaagtgctgggattataggcatgagccaccgtgcctggcctggcagtttgatttttaaaggccaaacctcttcagactccaaagaccactgggtccaaaaagtaccacagaagaacatcacctggaatctattaaacaggaggcccaaccctttttagtatagcaacataaaagcctaaatacacgggactccgtcccactttctcattcaacagcaatctccagattccaaagaatattggggccaaacagtatcacaaagaacatcagtttaccaaattctaatttcccattactgtatcaaacataaagtcatcaaaacacaatccaactgctgcagcaacaaacaagctccaagtgtgtccaaacggaaacagtcggtatgcttcctctctctctcagttgggcctgatcagctgcaaacaaaaattccttacgaatttctcaattgagaggagcccatcccagtgtctggtacccacaaaagacattcacttccctggacacacacacacacacaacacacaacacacaattacaagcatgtccccaagtgtatccatactgaaacagccagggtgcattcctctctcagtcagttaggcttgttcaacttgcaaatggaaattcctttaaaaatttgagaaattgagagcagatcctgctacctgggcccacaaaggacacacacacctatccagatgcaggtgccaattttcaaaggcagctcttctgaggcaatcaggaatgtggttggggccagatgcaatggggccggagagagacagaaacttgcttccagccaaaattgggcaagcagctatttaggagatcttctaagactcccagtccttggcagctgaaccatgagcaatgcttttcaagtcagggaatgaaaatctattaccagaacaccaggagttcaatctaggtcctgctgctcactgcacagaaggccaatcactgagacaataagtattgccaaggaggaaggctttaatcaggtgatgcagctgagaagaaaggagaacagtctcaaatccatctccctgactgattaaaactaggggtttatatagcaggtaagaaatgtaacaatgtgtaagaaaacaggaactaaggaggggtaagaaagcaattatgataaatgcagggggcctgatgtctcattgtctggatgtggtgatctgatgattttcaattatttggtaccttttttgagaagcctaagtgttgtttcctaaggaaggaactcagataaaacaaatgtaagtttcaagctttaagaccagcagggtcaatttctgttcatctacaaaaactgtttatatacaaaaaccattgacttggtttcaccaatttattttctctgcaacaaggtgtacaaggcttcccttttctctacatcctttctaacacttgttacattttgactttgatattagccatcctaacaagtgtgaggtgatatctctttgctttggattgacacatttaaaaagaatgcttttagcattatttaaacttatatttattctaacttactacattagcaaaacatttagtcttcaatagaaggtgatttgggagaaaaaaggaattatttgtccctaaattgtttccatgataatgtgtttctactccaattcctcaatctccctcatttttactctccatttgaaatctgtgtgtgttccaattaaaagtattctttcagaccaatatacgtgaaaagtggagcatagtgcagtattatgtaggagaagccaaacaagcaaacaagtaaacaacaaaggaatcacagtcatggtaattttcagcacttagttgtaagtaatattttcaaaggcttactaatttaaatactgaatatagagtcaaccaaacttattccaatttttgggtggttatcattttgtgtagttatgtcacatagacacattgggaaatggggaggtaaagcagtgtagagaagacaaaatccctcatgtgctctcatagaaaggtaataaaatctaaaattgataaattgcaagataataaattatgtatataatttagaaatctggtaatgccagaaaccaaagcagataaagcagtaaaaagtgattgccttttatgagagacgagaggaggagtgagaaagggcctcacactattttgttaaaagtcttaaataatatttgaggaaaaaaaatggatcactgggagaaaagatatttatggaaaataattatgttattattttacatctttatttgttaattagatttttggtgtgattgtcaatatttataagcttctgaggttttgcttttaatatgtatttttattttgagggtacatttcctaaaatgcaaaggcacatataggtgcctatgacaggcacatatacgtgtgttcagcattttatatagtaatgaagtcacaaatatagtcaattgaaagtaaaaatgaaataaatttagatatgctttttaaaagtgaattctgtactctgttcattgaatttaacacatctgctcagttttcaaaattattgtaatcacacaacagaaatgattagtaaagataaacatttcaaaaatgttattttaaaatgcttgatggcactaacttttttttaaagcagcttggtaacttttatggctgctagatttaataggagtcaccatggaaactgtctcacaatgctttgcagttgaatgagatataaaatacccatttaaaaacataaacactttgacagctgtaagaatatttacattttctcaaattatgatgtaatggtattgctaagggaatggagaaataagcattaaaacagaagatactcttggaattcttatgaactactcaggaactttggtttatctttatagatttttcctactttttgaaagatagtgaaagattagaaaaaatcataaaattcaagacattctgtccaagtatttagaaatcacttgctccttttcactcctttatctccatgctacatatccttttgctctttttttaatcttctcttcctaatctgcctgacactttatatcttctaaaatttttttaaattaaaaatagacagtgtattttaatgatcttcaggatttattcagggatgcactgtatcattactgttcttagtaaaaattgacatgtttgcttcattatctgaagcaggatgtgcagtgattcagctagaactcaggataagatggagggacacacagctccagccataacatctgtgttcaaggcagaaagggaaagggtgatgacagccatgtctcctcctccccttctcccccctcccctctcctccctctcctccctctcctcccctctcctccttcccctcccctctcctccccacctcctcctccccccctcctcctgccccccttccccctcctccccctcttcctctccccccttctttctccttctttctttctcctttttttgtaatctggaaaaaaaattcttccagaagccctcttcaccaagcagatttctgattatgtttcacagttgggttttatagatgctcccagattaaagaagttaaaaaaattaaacacgacttttcagcatcgatatataattaaaaatggcaagggaatagggggttagaaatggcatttctatagtcagtctgaagtgtctttctcagtgaattaaggatggaaaaatggtgaaggcagtgtgtcttaaacacaagtaacatttttgcaaaaagcacttaattattgccttggagtacaccacatcatggaaatgttgcacataactcgtgtgtgcaacattgctttcatagtaaggcaagtaaagcatcaaactgaggttcagagagatcagtggagttgttgctacacttcagcctgtttatcatgcctccttatcagtagggctcattttgattagtggctagaattgagagaagcctatgcaagcattttccactattttttcagaattataatttaggagctactcatactccaggatgatctcatccattcccattgctttaaatttagcatctgtattctgcaattaaatctgttccttttctggggttatctgtctcagtgaatgacaatattcctgttcgttggccccagacagaaaagttaatacactcttaaatctcattcctccattagtattgacatccaattagtcactaaacccttcctttacgttcttatcatttatttatttttgagatggagtctcgctctatcacccaggctggagttcagtggtgccatcttggttcaccataaactccaccccccaggttcaagccattctctagcctcagcctcctgagtagctgggattacaggcatgcaccaccacacccagctaatttttgtatttttggtagagacagggtttcatcatgttggccaggctggtcttgaacttctgaagtcaggtgatcctcccccctcagcctcccaaactgctgggaattacaggcatgagccacagtgcccagcctaacccttcctttatatatctctaaacaaaattttgtttcaactttgtttgaagacaacatctttctctttgaaagaaggttcttaatggctgcatacatttaatggtatggatcttgcctaatctagtcagttttttaaaattttattggaatccaaaattatatgcaattcacccttgaacaatgtggggggtaggggcgttgaccacctgtgcagttgaaaatctgcatagaacttttgactcccctcaaacttaattactaagagcctattgttgatcggaagccttactaattatataaacagtcaacaaacatatttttatgttacatgtgttatattctatattcttacactaaagtaagctagagaaaagaaaacgctattaagaagatcataggaaagaaaaaatatatttactattaagtggaagtgaatcatcataaaagtcttcattcttactgttttcccactgaatgggctgaggagcaggagaaagaggaggagttacttttgctgtctcaggggtggcacaggcagaaaaggtggaggatgtggaaggggaggcagaagagacagggatactctgtaacttcacagaaatacattgtaatttttgtcttccttttttctccaaaaatgtttctatatgttaccaatcattcttccaccatttgctttagtttcattgcccatattgtagaaagatcaatgtcataaaagagtaaaaatcagtcttgagtaaatcagactccttctgccagattgtctgatgttaatttgttttctggcactgcttcttttacatcttcctcattgtcactgatttggaagcacttatcctcccatcttctgttaattcttctggtgtggtgtctactagctcttgattttcgtcaagattcatatcttgaaacccttcatcccactccctctttgctgtatcgacaatctctttcacagtttccttgattgactctatcataaaccctgtgaagtcatacacaacatctgtacacatgtttttccagcaggaatttattgtttcaggcttgatgacctttacagctttttaaataacaatgatggcatcttcagtagtgtaattttcccagactttccaacattctttatatcagggttttcttccacagtattgacaatttcttacgcagagtaccatgtgtaataagccttaaacgtcctgatgagccccttgatctaaaggttgaattagagacattgtgtttgggggcaagtagaccacttcagtgcctttggtgtagaactcatgaagttctgggtcaccaaggtcattgttcaataacaatagagctttaaaaggcaatttcttactgacaaggtaattcttgacttcggggacaaggtattgatgaaatcagtccagaaaaagtgttcttgttgtccaggccttctttttgtacaaccaggactggtagctgatgtttatcttttcccctcagggatcagagattagcagctttatagataaaggcagtactgattataaacccaaatgaattgcacaaaactgtagagttagcctgccccttcctgtcttaaatcgtggtgctcatttatcttccttactaataaatatactttctgacattttcttccagcatagggcacttttgtcttaaaacctttttcaggtacatatatcatttctcctcaatgcttttcttaatggcttctggaatttgtctgttgtctcttggtcaacagaagctgcttctcctgttaacttgacgttttttaagccaaacctctttctaaaatatcaaaccatcctttgctggcattatatttattagtttttttctttcacctttcttttgctttaggttgtcacataatgacttagctttttcttgaatcatattagagcttataggtatgcttttcttatggctgtcctgcatccacaaaaaaaagctgtgtttttaatatgatataaaaaggtatttcataaaaagagcaaggttttcatgttgctagtgtggctgcagtgagagcttcagtaattttcttttttccatttatttacaatgatccttatgctgtattcatttatcttgaaatgtcaggcaactgcagctacagacctcattttatgattacatattgagcaactcaacttttaattgtaataatttgacttttctctgcttcttgggagtgctcccaaggtatcataatatcattcaaggtttatggtattgcactaaacatgaaaaatgtgcaagaactatgacagaccactttttactgtgataaagcagcctactggagagaactgctcatgaggcaatggttagaatcacctggtgttttaagctaatactggcaactcttgagctcatctcaacagcaacaggaggcagctacacaattattacagtagcatggtatgtactacagttaattttatacagttaaaatttaatactgaatctttgtatttatttacatgtctattaactgtgatggtgccatgtaggtatgatctgttcatgtgtgtaagttttggtaaattttaacattttataatttgtgtatattttgtggtagtaaatgataacatagactcgtatataatatctacatatattatttgcatgcatgacatacttaaactttcttaaatttttttatgttcctaggctacatagttcatctgctttttgatttatcacaaatctccagacaaatttagtatatttgttttttaaaactcatgtacaagtggacctgtacagttcaaattcatgttgttcaaggatcaactatatacatatatatagatttggatgcgaccttgtaattcagatatgtacaatttaagttcttagatggtcaatgtacatctctggataattttttttctggaatttatgcggattttttagtttttttgacattttttgctgtatgtttacatttgaacaacttgactggaataggatttggaaggggagttgtcataatttttaaccaaatgttccttttttataaatattattttattgtcttttggcaagatatgtttgaaaccagactagttttttcaaagtttatgccatctttatttccttaattaaatgaattattttatgtttttattttaaatgcagggggtgcacatgcatgtttgttacatgtgtatattgtgtaataatggggattgggcttctagtataactgtaacccaaatattgaatattggatacagtgttcagttggatagtcttacatttcctttctcattggatacaatgttcaacattagattggatatttttggagtccccagtgatgttagcctcatgaaataaattaggaagattttaatcattgcaatgctttagaatagtttaaataacaaactttcttaaactttattacatatacttcaatttttattaaagtatacatgtgcatagcttaaaatgtaaaacggtagtacaaggttcaaagcagatacaatcttttgaccttattcacaagggcaatttctcagatgccaactctattaatgctgtcttctttttattctgtgtttctaaataaaatacttgaatgtgtttgtggcagttatgatgaggtttggctttaatacagatcacaaatggcagtggcttatataaaacagaactttgcttctctgtcatataaatgtctggagggtggatagtccaggcaatgtatggcagcccggctccatggagttctccatggatgtttctatcttgtggctcagtagaacatgtcctgtattgctaatgttaccttatagaccaagtggctgcttcagctccagatgttacattccagctagcagaaagaagaatgagatgaagaattccctggctgccttttaaggaagatgctgggaaactaatacctgacatatctacaggccagaactcagtcatgtgactgtaaacacctaggagcaagagaagtagggaaacgcagccttgcacctccatagcccattgctgtggagaaggggagatagagattagaggatagggagtgattttccatttttatttcttgattttgcaattctagacattttctattaacatgttatgaaaatgtaggattgggatctcttacatccattaaattccaagtcttgatccttctcctcaccatttatgtttcttcctcgtattttaaaaaattaaatctctatttattgttcactattatttttacagagtaaagattggtcacggccaggcacggtggctcacgcctgtaatcccagcactttgggaggccgaggcgggcggatcacgaggtcaggagatcgagaccatcctggctgacatggtgaaaccccatctctactgaaaatacaaaaaattagccaggcgtggtggtgggcgcctgtagtcccagctgcttgggaagctgaggcaggagaatggcttgaacccaggaggcggagcttgcagtgagcagagattgtgccactgcactccagcctgggcgacagagcgagactgcatctctaaaaaaaaaaaaaaaaaaaaaaaaagattggtcacaggtgttccgtatagttttacatttcctttctcatacaatttttgtttttcctggagataataagtacttttcatttattcacttgtttctatatctgtcattgatttgtctttcaattgttcaaataaaagtaaaactctaataataaagtccaatatatcagataacatatcatttttttccctagaagccacctggaggcctctgccctcttgctttattctacactagatgttctctaggcctgttacacagctgtcatcctaagattttctttgccttcatcctgtgaagtcccttccaattttacttgtgaagacaaacctttttggcaaatgatgtctcttcttctcgcttcatttacttcttaatactgaaggcaggatttctctgtaaacttctaggaatttgtaaattttttgcgacctcgaatataaaaatatgtattttacctctcacatttaattattagcttggctggtcatagaattctagagttcaaaataattttatcttggaattttgtttccttactttttaggttccaggttgcttttctggagtttgatgccattgtaattcacaattctttaaaagtgcctattttttaaaaaacggtatttattctggaagcttttaggattttttttctagagttctgaagctttgcagtgatatacttctatataaactttttccattcattttcctgaacatttgattgtcttcatcagtgtctaagtcatatccatgggtataaaaaaattattatttcagtgataatcatcttgctttccatttttcagaaactcattaagcattagcattcttcttctggaattcataataaacattggctctcctaaattgattatatgattttttcttatattttccagtttatccttttttggttctcctttttaagatgaaaattttttcagctttgtcttccaactcttctactgaatttatacttctaccaaaattttaagttccaacaattttttgttatcaaagtatttattagtgtccttttattattttaagaatttaatattttggtttttttgggctactgataattaaaacttttgtatcctaaccctttatgtaacatttctgattcttcaaaaactttgttttgatgtttgtgtttttgttgctgtctttcacagtggaaacttttccaaactatatgatgtcttcatatttaagagtgagacaataaaatgttcattcaaaattgtgctttcaggcctcatataggatgaaatagctggttactgaggaatttcagtgtctatgttattttctaaagcttagtataaactttcagtctcccatctggtggtggaatgggtcaaagtctcacaccaagttttcatggggcctgatgatagagaggtgaatgaggatctcacagtttgacttgcacttaaatctctgtcttcagtaacatgcctcactttgtcttctgctgtccagagcctccacaaattgtaaatatcttggtgtcatctacaattgaaaaggaggtagccatgttgatatgtgggtttggagggggactttagagaactaatatttaggctcaagttaatcaatatcttttttattcagcaggctataacctcctgatggcttcttcctgcccagcacagacaaagccaagtcactgagtttaattgacgcgagactggctacaccatgtaggagacagagttattacacaaatcaatttttccaaaaattcagaggctagggtttttcaaggatactttggtgagcaaagggatgatgatgtggaaaaatggtcctcttctggatggggccacaggataactggtgggtctgggtgaagccatctctccagacatgcaaaaacctgcaaaagacagctcaagaggccaatcttaggttctacaatagtgatgttatctgcaggagtaattatgggagttacaaatcttgcaacctccagaatagtggctggtaattgtattcaggctcctcacatcttcctaatgtattggccattcattacctttacaaaggtagtttagttttgaggaagggctattattatttaaattataaactaaatgtcttccaaagttagcttggcccaagccctctagtaattaagaagaatttggaggttaaaggcaagatgggagttggttagatcagatctctttcagtatcataattttctcactgttgtaatttttgcaaaggtggtttctaggtcactccactttccaccattgccttcagtgatacccattgctgcctctgattcttaagcttctgtggccctttgagttgcaaatcttttactcttgcaggcttccttcccactataggctgttagcagaactcagaaagctgaagcattcaattattattatccatcatcttttcattttccaaaactgtaatgacctcttttttctgctattaatgtctcttctattatctctgtgtgtttggcttaatatatctttttaaattctttgccttttattttagtatatttcaggaggagtgaacataacacatttcttcaacctatgtttaattggaggttgattatacattaaatatgctaactttaatattctatggtttttatgggtataaaacattttagaatttataagtatattttctaccctttcctatatttgccttcctaatttactcagtggatcatatatttattcagtatgtttgtactcaaaagttttgatcttttccttagctatcattatagcccttttgtcattactgtttctgatgatatattatttccccatggttttttgggggggttggatttactagaggtttatctattttattgtccctttctaagaaactgctttttggttttatttctcacttccagtttcttttgttaaaaaaaatgtatgtgtagccacccaacaggttcaccttgccagctgcctagatagagccaatttattgagataggggaattgcaatagagaatgagttattcatgcagggctggctgtgctggagaccagagttttgtaattactcaaattagtctcctcgagaatttggggattgacatttttaaggacaatttgttggataggggccagtgaactggagtgctgactggttgggttggaaatgactccctatggagatggagtctccatagggttggagatgactggttgggttggagataactccctatggatatcaatccctatgatttcatagggagtcaatgctgtcttctgcactgagtcagttcttgggtggggagccacaagaccagatgagtcagtttactgatctgggtggtgacagctgatccatcaaatacagggtctgcaaaatatctcaaacactgatctttggttccaaaatagtgatgttatctccaggagcaatttggggaaggtcaaaatcttgtagcctccaactgtatgactcctaaaccataatctctaatcttgtgggtaatttgtttgttctacaaagacagtctagttcccaggaggaaggggggttttttgagacagattgttactgtctttgtttcaaactgtaaactaagttcttcccatagttaatttgggctatgcccaggaatggacaaggacagcttggagattaaaagcaagatggagttggttaggtcagatttctttgactgtaattttttcagttacaattttgcaatggtgaattcatgtgtatttacaaatgcatttactttgtgctttgttgtaatgaattctttttcttttttttttttttttttgagacagagtcttgctttgtcgcccagtctggagtgcagtggtgcgatcttggctcactacaagctccgccttccaggttaatgccattctcctgcctcagcctcccatgtagctgggactacaggtgcctgccaccacgcctggataatttttttgtatttttagtagagatggggtttcatggtgttagccaggatggtctccatctcctgacctcgtgatccaccctccttggcctcccaaagtgctgggatgacaggcgtgagccactgcgtctggcctgtaatgaattcttaacatgaaattttcttaggtttattttgtgtgttttttaaaattattgagttgaatatttaatttatttttaatatttattattcaataataaatataataaagcttttaaattttctactaggatatgataaaataagtgtttcattaggaagcattcctcccattattaatttatatgttgtatgtcattacactttctagttaaaataatttattgcctcagattacaaaagtaattgcaaacttgtttttaaaatacttaaatatagaaaaatgattatattagtctggtgcagtagtaattgcagtttttgccatttaaaagtaatagcaaaaactgcaattacttttcaccagcctaatatatttttagtgaggttccaagcaataaaaggtatgtaaatagaaaatagtatagcctgaagctgtaagaactactatgaagccagataaagaaagataaacggttagggaatgacaggaggggtaggggagacatgtttagctatggtgttcagaaaaggcctaggaatgtgacatttgaaaagataacttatggatatccctgagcaatgtgagcatttgggtgtagggggttgtggtgcagaactaagggaatagccagtgtaaaagtctcaggcagaaactaggttatttgcacaaaagcaaccacgtcggtgtgaaataagtatggtgagggaggagaaaaatgttcttagatgagagataaaaggtgattgggggcagattatttgacaatccatagaaagctggacttgaaaaccatctatggtcacacctgtaatcccagcactttgggaagccaaggcaggcggatcatgaggtcaggagatcgagaccatcctggctaacacggtgaaaccccgtctctactaaaaaatacaaaaaattagccgggcatggtggtgggtgcctgtagtcccagctacttgggaggctgaggcaggagaatggcgtgaacctgggaggcggagcttgcagtgagccaagatcatgccactgcactccagcccgagcgacagagcaagactccgtctcaaaaaaaataagaaaaccatctatgggtattgagcaggagagggaatgctctgacctaagtatggttagtgttgtgtttgttactgggtggactagatatcatgctgcaggaataaagaaagcagggacaccaggtagaagaatattctagtaatctaggagagtgatgacgaaggtgactttattaagtttgaacctacactagagatggtgagaagtagtcaggtttaccatctgatttgtgggtggagaggatttgctaataaattgaatttggggcctatgcaaaagagagttaaagttactgctcaacttttcggcctgtgctctttggtgcttttgtttactaagaggaagatgggttggccaaaggcagagtttttggtgtcagataaatcaataaatctgtcttagatactaactttgaatttgtctattaaatatatcccagtggagaaattgctttgaccatggaatataagcatctggagctcaggtgagggcctgaggcaaagatacaaatgagccatcagcccagggatagtgttaaaaccacggtcttgaaaagaactgcctgcaggtattctgtagtggtgtctgcctttctgtagataaagaaaggcagaacggggctaagtaataaactatatacaatgatgctgtgagtatgaattgattgccatttgggggttgataattatatttggaaagatgaggtagttggtgatttcaacaaaagttaaatgatggggaagaaatattgaccagaatagattaaagagcgactggacaatcaggagccagcaagaccccttttggagagttttctgtgaaataatacttaaaaatattttatggtcaacagagtgtgttatattcatctgttttcagagcaaaaagttggaagtagataattggttatatgttttcactaacaattatgtgttataaataattatacaataaacatgtaaatatataaatataatatgtaaaatatggtagattgtattataaatatgcttgttatatttttataaattcctctaaattgtatagatataattttaatcttagaaattatatctatatacagatttataatgcacataaatacacttatgtacatatgtgcatatgtgtgctgtgtgtgttgttgtgggtggaactagctggggctgatgttatgggcaataaaggaatttgccaagacagctgtaggtaaggaaaggcagatttattagagaaagtatgaagatatgttgcaatgctgcaacaggcagcacagcagagaaggggctgtctgcagaggcaggggccagtgggaaatgttacagggtcatgctggagggggttatgtgtggaacaggttgttgtgccaatggaatgaggtggttgtacctgtaggttgtttgcaattagccttctctcagagcaattgttcatttttctccccaatctaggaccctccctgacctgggcttccctcctcatagttgcttactcatcaggactccatgtgtgtataatacacatatctataaagtctgatataatgagagagattaatgacaattattcacaataattttggttgtattaatttctccttatattttgctatgtatatagaattcttgattcaacacattttgtctgtaaaccatatatatgttccactaatgtttctgaatttttgatatttagttctgatatcaaatgtcagtctcactccctttactcagtggcctttgggctctgatactaggtcagtcccctggaactctggttccctcagctgcgtgggaaacagctctgctatatgctcatcacataggagctgtagctaaccagcagtatccagaatcagaagactcatcactgtctctgcccaatcattccttaatcacccagataacccagttgtttgcattcttccttactctctgccagtccccggttaatgttctcaggctccctcttacctctcgatgtttctaaaaactcattatttctttagcgtagcaacagcaagaaatctggtatttcatttctttgctatttcatccctgccctggtcatacttcctccccatcccactgtcagaaagaagttggtttcaggctttccccttcctctctgtgatattttacttctaccttggactttattgctttaatgtctttggtagaaagagccacacatggtgaaataatctctatgatctgagtcattatttgtgtcctttatatgttaatgcaagatagatggctttagaaaggactttagttttattttcaagacttaatatttcttcaaaattttattttggttttctacagaagcatatttacattgaagctaatgaaaattgagcttcacagtctgttcacatgatcatatgtttttgtgggttttttttttgtttttttgcaaaagtgcattatttttgtattatttttattaaagagagataatgttatataagtgtcagattccacaaaatctggatatatccttggataagttaaatggttgttttttccttccctcccttccttccttttgaaatagtttagggtcattggtcatgttttctggggtgttatctgagcttgtggtctcatgaccgagaatattaaggagcatagacacggacgccagagtgaggttagagcaaaagtttaataagcaaaagaagacagctctccatagcagagggatcctggacaagttgacattttacagtggaatgccaacttttataagaaactcctctcatctctgtagctgtttgagtaacttttcttatgtgaaaagctgtctgtacaactctccccatctttacagctgtgggatgtctctaggtaagcacaagcatagcttttcttgtttatataattgtgggtttgttttaggtcagttcccctccccttcctgtgcaagctactatgaagcctgccatagtcatgtctgaaaaagggaggaacattttgcctgggagcccactaatcacaaaaagaacaaaaggcttctatgcgggaccttggctgcctggcctacttatctgtacagctgcagcctgagttttcttcaggctgctgtatttttgcctgtagctgtgatttttcagagctgcttctccaactagccatagttgtctgcctaactgatttttccttttcttctccctcattaccccccacttcaggataagagaccctaactgctgttaggaaggtcaggcaatggtatttctagatacttcctgatggagaggggtgttgtgtcgagaacaccagctagggtttcttctgggcctggttcaaaggtccttggaagaatggcatgtccatgtggggttccatttgcagcactacttggagtttaatagcctctaggtgagaggaaacaattccggttatagcattgagtatacagggtccaaacttaacacaagacatacaagaaaaagaggtcccagtaaaggagagctaactaggtctaaaaagaagactggaatctttcaagaagggattgtagctacctgggactgaagcctgctctttctcttaatgtgtcaatgattctaatttgattcttaagcacctgtaagttttattccaattggctagaggtgttgatccaaaaggaacatgcttcatttaagagtacacaggtctttgggaggcggaggcgggcggatcacgaggtcaggagatcaagaccatcctggctaacatggtaaaaccccgtctctactaaaaatacaaaaaattagccgggcgtggtggcaggtgcctggagtcccagttactcgggaggctgaggcaggagaatggcgtgaacccggtaggcggagcttgcagtgagctaagattgcgccactgcactccagcctgggcgacagagcaagactccgtctcaaaaaaaaaaaaaaaaaaaacagtacacatgtgccggccaggcatggtggctcacgcctataatcccagcactttaggagtccgacgtgggcagatcacgaggtcaggacattgagaccatcctggcgaacatcgtgaaaccccgtctctactgaaaatacaaaaaattagccagccatggtggcgcacgcctgtagtcccagctattcaggaagctgaggcaggggaatcgcttgaatctggggggcggaggttgcagtgagccaaggtcgtgccactgcactccagcctgggagacagaacaagacttcctctcataaaaaaaaaaaaaaaaaaaaaaaagagtgcacaggtgcccccctactttggctgtaaaaacatctagggctcatctattttgcattaccactgcggctagagagtttatggattgttgttgtgcctctttggctcctactgatgtcttccacccttgttgcatcataatagagatattaagtactgatctctcaaaaagagaaataccagcaaatcaaaataggcctctggctatagcatgtcccattcctggtttttccagtataggattgttgtgtgcatgtcctccccagtcctctctctcagttagatctccataccatgttatggaagtaatagacctctgtgtttagtgtacctgagatagggtactttctagaaaggagcacagattatgaattccatcagatgatgttgccatgtcagtggagtttaaaaataataggtcggggaccactgccactatagtgcatgttcccctccaatgcctagggagaattaggtgtaaccaggaaccacagagaaaataaagccctgtcccttgaagggaggattctaggttgtgatgtgtaagagatgcagctagtctttgcatccgcttcataaagaggttccccttatatctaatgggagcatctttgatatagggataaaaatacaaagtatagtcatttatggtgccatttgggactctacacactaggtgggaaggatcctgctgacagatggagctttggaagataatatgtcctgaccagtatctcagttgattcttaatgcaggcgctctcagtccagacatctccttttcgcccactagtgtgtaggttattactagtatcaaatatcttacaggggtctgggattccctgaggtggcatatttggaaaggaccgtgtgttatttgctattctgatgtaatactggtaagaggagttacgcaggggctgccgctcaaatttagaatcacagttaggaggcgtggatgggttttttaagtttttcaacattttatctcacgtgttagattagctttctcctttttttaccctccagacctcctcacttttagagattgtaagtgtaatgttgcagtatttgagatttcccgggtatggcacttttcctctgctttcaaagcagagggaggcatctgctatcattctatcaacttcacctagtctaaggatgtgtcttatccccaggggatgtgtgttcctgggtagaattaaaagtgctcccatatcaagttccatttatacctgacaagttcttgatggttaagggcaaagctatcaaagggaaccccaggactatgagttaaggatcatcaagaagcctcccagtttcagtgttattaaactgagcaaattgttcagggaaaacccagcaattagtcttgctgtatagatgagcaatggctggtactgttcgggtcaaagactaaaaagcattcctgcctctaacagtgaatgctactaagcttgacagaaacaaatttgcctcttatctgttactgccatccctgcaatgaagataataactaagcaaaatattacagaagtgagactgtctgtctgcttttccactcaggaggtgccacagggtgtaaccctactgcaaaagcaaagtaagcaaaataattcctgcaagtatggtgtagttaatgatttccatctgagtttctatttgtcaaaatattggattttcctctgggggggtctatggagttatgaatttggtcccatggataatcaaagtccccctataaatttgcatcaaaaagaagctgcaatacctgacagcagatctcaaaaggaaaagtggaaataactgaaagaatctggtagggtaaaggtgggattgagttagatgggtagtcctcactcatttacttatcttttctaattttcagtgtaaggtgcctgacttcttcacattggtacctgggatgctcttctgggatgtcaggggctgctttctctgctttccaggctttgacttgagtgtgataaatccaagagttgatacctgcaaccttaacctttgagagagtagagaggaggacagtgtaaggtctttgcaaatcggggtctagagaaggggaaagagagggaagagtcttcactaacaccaagtcttctgggttaaataagggcagtcctatttcttgggggttcagcttccaatggttgttttcattcctattggaagtgggcaaggaggttatatatttagctaattcagaagtttccttgtcaaatagaaaatcattggtaagaaaaggccaaccacacattatttcaaaagggcttaaatccaatttggaggcagtgcttctcacctgtagtaaagccacgggacgaagagtaacccaagggaggtgagtttcttgagagagcttcctcaggtacctcttaatgacatcatttgttttttctatttttcataaagactgtggtctcgaggcacaatgtagatggtattatatgcccagtgcttttgggtaacagacatcttaaatgaggggtccaatgtcactttggaggtacttcaggagtccaaaacaagaagttatctcattaattagtactcttaccacctcagaggacttttctatttgacatggaaatgcctccacccagttaatcaagatgtctatctatactaaaagatatggaatgccccttacttttggcacatgggtgaagtctatcctccagtcttctgccagataacttcctatcctttgaatttggtggggaaggagctgcctgttgaggggattatttttaaggcaagtttcacaagcattaacaagctgaccatttttagtaggttttccccccaaaacaatctttgggtgcattgataagtcttatccccacctaggtgaaaggtttggtgaaggagtttaagaacttttcactgactagaggctggcaagtggactttactgtgctctgagtgtaaccatcccgagggctgaaaagtgtatccttgagatgtggcttattctatttctgcagaagaatactgaggtcttacttctcttatggagccctcccagattacaggggtctcaaatgtgtcagatctcctgggtctttttgctgctgatttggctgcttgatctgctagtctatttccctcagttatgtcatccacacccttctcatgtactctgcaatgcattactgccacttcctacagaaggaaaattgaggatgaagtctgcctatttcctgatgaatttaatggaagatccattaacagtgaggaggtgtctttccttccagatatcagcatggacatggagaaccaggaaagcatagttagaatcagtataaatgttaactgcctttcctttgctttatttgagcatccttctgagagcaactagctcagctagttgagcactgatgcccagtgagagatgtgcactctcaataatgacattcagggtgactactgaataccctgccttatgggtttcttgttctgtgaaggaacttccatctgtgaagacagtccaatctggattttctaggggagtttctctgagatcctccctggcttcataggtttgtactactatctgttcacaatcatgttcaggttctctggtttcctctgagaggaaagtgcagggtttaggcaagggcacatttttaactgaactgcagatcctctagcagcaaggtttgatatttgaggaggtgattgtttgttagccagagactccctttagaggatagcagtcctgctgtattatgtggagtataaagagttaaattattctccatggttaacttggtggcctctggcaccagaagagccactgtggcacctttagccaccaaatcaagccccttacttaggtaactgacagactgctgggatggaccttgggcctgagttaaaactcccaaggctatttctttccttctgagacataaggattgaatgcctttcctatgggaagactaagggccagtgctttaagtaaggcttgctttagctagttaaaggatttttgggcctcagattcccaggttaagagagtgagttttagcacctgagtgtcttttatagggtgatacaaagggtgagcaatttcaccatacctgggtatccacaatctgcaaaggcctgtagtacccaaaaatattcttagctgtttgaggatttgggaaaggggaaaggaggtaatgggcttaatcttctctttgcccaatgttctagttccctctgacaggagtaaacctaggtacttcactgaggtttgacaaagctgagccttaaattttgaaaccttatatcctctcttagctaggaaattaagaagagcttcagtgccttcctgagaagccttctcagatgaggtacagtggagaatatcatcagcattgtaaaattttaatgtgaggatgagacaactaagagagatctctcaaaattgcctgcccaaacaagtgagggctgtctcagaatccttgaggcagcactgtccaggttagttgggcagtctggccagagggatctttgaaggcaaacaggtattgagagtcagggtgcaactaaatgtagaagaaggtattctttaggtctaaaaccatgaaacatttagatccctcagatacttgggttagcagagtatagagattaataatcacccaattaattcgaaccacagcctcattaatgagatgtaggtcctgaactagcttacattccccactgggtttctgcactcctaatattggatgttgcaggggctgttgcagggcctaaggaggccttgtgcttttaagttatccatgatgatatctagtcctttttcagcttctggctgtagggggtattgtttctgcttaggaaaagaagtggaatccttaaggtgaatctggactggtatagcgattgttcagccaatctttccctgaattacccatacctgtaagttaatattggtttccactaagaggagataaagagtttgttctgaagccattaggatggcagctcacatatgggctagaatatccctgcctagcaaaggagtgagactttcaggcataattaaaaaggcatggataaaagcaggttcctccaactacagctgagggtctgagaaaaatttcaagttaagggcttccctgagatgtccatcacagtcatgctaggggaggagggaatgcctggattggagaggagaaccaaaagactggctccagtgtccagaaggaagtctactttcttgccttccacctccagaatcacccagggctcctggatagtgagggcagtttgagcttctggagtcaaggatctttgccaagaccagctcggctggggagaccctaacccagcagcactagaggaattaaagacacacacacagaaatatagaggtgtggagtgggaaatcaggggtctcacagcctttagagctgagagccttgaacagagatttacccacgtatttattaacagcaagccagtgataagcattgtttctatagattatagattaactaaaaatattccttatgggaaacaaagggatgggctgaaataaagggatgagtttggctagtaatctgcagcaggagcatgtccttaaggcacagatcgctcatgctattgtttgtggtttaagaacgcctttaagtggttttccaccctgggtggaccaggtgttctttgccttcattctggtaaacccacaaccttccagcatgggcatcatggccatcacgaacatgtcacagtgctgcagagatttttgtttatggccagttttgtggccaatttatggccagattttgggggacctgttcccaacagatctaagtcccaggatccatcagtcctgctggaccatctgtgagactggccttggacttggtgatttatgcctccagggacagtccaacctccagtggtccccaccacaagctagatagggtcaaggtggcttctttttgttgcctgggcactcccttttgaaatgtcctggcttaccacactggtaacaatttgcaggcgtaccctggggatcctggagtttataggcctgtaaagcaagcactagtgcctgtgtctctctcttgtacttcctctctttttcctgggcctcttcctggtccctgttgtaaaagaccaaggtggccatgctcaggagatttttctgaggtgctactcagtcctatagcctgcttccatagcttccttctgatatcaggggttgtctgattagtaaacttgttttttaatattaactgcccctcaattgaatcaggagatagagagatctgtttcagtaaagcttccctcagactttccataaaggccaaggaattttcatctggtttttgatctatcatagatagcttagagtagttaagcgatttggccctgatcctttataagcattccagtatgcacattagaaagtgttttctttcccactcatgtataggatcactggggttccaattagtattcttaaggggtactgcctcactccctgttggaaatggagtttcttgttcctgttattgttctctaatcccccttccagtttcttccaagttctttagttccccttcttggatgaggaggttttctttggctataggagacatgttgtttatcccaacttttctgctgcctgtaaggttacctgtttctccacagcagtcagggtttggattagaagaacataacatctctccatgtatgatcaaatacttgggttacttttggaaagcctctatatatcagggtcatcagagaaccttcccaggtctccctttatttgcctaagttcttgtagtaaaaagggaacttgaaccatagtggcatcatatccactgggcatttcttgcaggcataatagtgaagtcaagggagttggaggctttggagtggatggtgctggaatggccgatgatatagctggagggggcccaagataaggggtggggggtttgaggggctgaggcactcagaagttttctttgatggttttccaggaattagtttctctgattttggggaatcatccactatgtgcctgcctgatatgactgcttaaagagctggatcaattgtgcaatgcttacaaagatttgggttgtgtcgcaggacaaagaaagccagtacatagggaactttgaatcatttgccctcctgtctgcagacaaaatctaattgttggatagtattaaaattaacacttccctcaagaggccaggcctgtctgccctgcagttggtaataaggccacgctcttgtacaaaagaatatgagccactttttcttcagggtctgatgataaaagcaatcccagtgtctctggctgtacttgagaggagtgcaggctgaggatggttttttacccatctagaaagagaaaagagaaggcattccttagtctctttcctttcttttggagtgacccagcatggagaaaaagacagaaggggtgtcccccctctccccttctctctttggttgtctgggtcctggtaacctttgtagatgctgcccatgaatgcaagtgtgacctttttttcatggatcccgaggagctagttagcaggaatagtcaggcttatctgctgaagtccctagctctctgctggtgcttcccctttaactcccttgcgtgactggtatggatcccaggtctcccaggtatatggatcctgggaaaaaactgtataatagttgtacttgggcaaagccccctaatggagggaatgttctagctctaaatacctatattcaggtattttggcccagactaaagtactcattcctaaacaatgggtccgattggcttccaaacataaaacccctctttcttttagatgccattgcaattggatgcagaatggatgccttaaaagaatgtaggaattgaatggctgtcttccttcagatggagacagcgtggaggctaaaatctgcctttcaagggcaatttccaccacactgtcaaagacatagtttctccattcacagataagacatggagccagatgtctgatagaaaggtgcagatgagagaagagttgggaaattatagattttggacaaaggactaataagtctccccagggaaaaatcccatctgactagttggtatgacagagattggaacactaaaaagtagctctgactccaattactctccagacaaaggttagaaagggaagtttggggctgtccccacaacatgcctccccacaagaaaaaaataatccatctcatagagagactgtctagttatgctgcacagtgctggcttctcacatggaaaaagagacagcttaattaatattccccccatccaaccccattgagggctatcattgagagataaataggtctttagatccaagtcttggaatctccctgtttcaagaaaatcacagagacagcaattccttgaaatacattcttgattactaaggccccagctgactttacccaacaggattatatgcccaggttgtaaaaacacttgcaatattgcattcaaagaaggaataggagacatgatagccgcaaaacgaaaggaagaaaatgcaacagaaaactctggaagtcctggtgccaatacccagcaggctgtcagggactggagttagtccaagggcctccaggttacaccgaagtgtagccttggccaaaaacctttggttgcctgaggacctccttccagccccatgcaatggctaggtcctccacaaaagggaacttgattggaacacagccaacattcccaacaaccaagggtgagcagggttgataaagtcctctcaagaaagcctgtcccctgagtcttgtaagactggaagttaccctattggcttttaactgactgatgggccagtgtgtttttttcactcttgagagaacaaaactgagaacgagaagcctcagaaataaaagtcaagagttaagagtttgctcctactcactctttcgatggatcccaggcaagcccacactaataaaacagtatagggtcactgattacgttgtctgggatgttattcaagcttgtggtctcatgactaagaaaattaagaagtgtagacatgaacacaagggtgaggttagaacaaaagtttaataagcaaaagaagaaagctctccacagcagagaggggtcctggacgggttgccattttacagttgaatgctaaagcttttatgagaaacttctctcatctctgttgctgtttgagtaacttctcttatctgaaaagctgtctgtacaactccccctatctatgcaactgtgggacattcctaggtaggcacaaagcatagcttctcttgtttatataattgtgggtttgctttaggtaagtcccccccttccctccctgtgcaagctcccatgaaacccaccatgttaatgtctgaaaaggggagggaatgttttcctgggagcccactaattacacaaagaacaaaaggcttctatgctggaccttgcctgcctggcctgcttatctgtacatctgcagtctgagttttcctcaggctgctctatttttgcctgtagctgtgatttttcaggcaggctgcttctctgaggactagccttagttgtctaccgaactggttttttcttctacctcacttccttccttccttcttttttctttcttttcttccttccttttctccttccttctaccccacctttctctttcactctctgcttccctttcttttcatccatcccttccttccttccctccctctctctttccttccttcctccctccctccctccttccctccctgcttgacctttccttccttccttccttccttccttccttccttccttccttccttccttccttccttccttccaaaaacttcaggatactaaaacaataatgataatgagaacaactataggtaatatttgtggagcacttactatgagccaggaactgctagtttgcaaaaatcaacaatcaatgtagtaagtcctactattatccccactttacagataaagagtcctagatacagagagatctaacagcttgcccaatatgtcatagaataggtagatgtaacagaagcattgttagcctatacagagcctttgggcagtttatataaaagcatctctacctctaactgcaggaatgacaaaaggcactcctttccatggtcatgtggccccatatcagggcacactgctgggctgggagatgaggaatggctgccaggctcctactgcacttttgccctggttccatgggggcaacacacaactgtacagccttacagtccctagacttaaatacaaggaatattaaatgaaaatgttaatagcattgacactcatattaaaaatattatcttagaaattcattagtttactaaagctgttagaataaaacatttcaggaaggtgtatatcatcaatataaatacgggttataaaccaacagtattttaatatatgagcaataaataatcacaagatttaataaatacaaatctatttttactagccattatcatccagaaatattcttgaccaaaaaagtccctcaactagaatatatgtgaactatgtgaaggtaattataatattttaaagagataaaattagaatttaattatattgactgattatataatacttctaattagaaagattatatattttagaggtagaatttttttttaccaaattaaaatatataaaatttgaacagattcacatcacaactagaagacttaatttataaaatagcaaaacaagtttgcacaaatatttaaaaatattaagacaactatttggtaggtggaattctaagaaagccctcatgatctgtcctttgtgttacatctgtataacttcctccctttgtgtgtggatggaacctgtgatttgcttccaaccaaaagagtgtggcaaagttgatacaatgttacttctattattatatttcataagacttaatcttacctgactggggaggaagaccatccaccttgaagtagcaacctgccatgttgtgactacttatggaaagggccatgtattcgttcgtcctcatgcttctgtgaagaaatacctgagactgggtaatttacaaaggaaagaggtttaattgactcacttccacagggcgggggaggcctcaggaaacttacagtcatggtggaaaaggaagcaaacacgttcttcttcacatggcagcaggaaaaaggaatgcagaatgaaggtgggaaaggccccttactttaataaaaccatcagatcttgtaagaactccatcagtatcatgagaacagcatgggagtcatcaccaccatgattcaattacttcccactgggcccctgccatgatatatggaattataggaactacaattcaagatatttcagtggggacacagccaaaccataccattctgcccctggccccttccacatgtcatgtcctcacatttcaaaacacaatcatggttgggcgcagtggcccatccctgtaatcccaacactttgggagggcaaggtgggtggatcacttgaagtcagaagtttgagaccagcatggccaacatggtgaaaccctgtccctactaataatacaaaaattagctgggcatggtggtacatacctgtaatcccagctactcaggaggctgaggcaggagaatcacttgaacctgggagacagaggttgcagtgagccaagatcatgtcacttcactccagcctgggcaacagcacaagactccatctaaaaaacagataaacaaagacacacacacacacacaatcgtgccttcccaaaagtacccctaatgtcttaactcattcaagcattaactcaaaagtccaagttcaaagtgtcatttaagacaaagcaagtcccttttgcttatgagcctgtaaaaccaaaagcaaattaattacttactagatacaatggggatacaggcattgaggaaatacacccattccaaatgagagaaattgaccaaaacaaaaagactagaggccccatgcaagtccagaatccaaatagcagagtcattaaacaataaagttccaaaatgatctcctttgactccacgtgtcacagccaggtcatgctgaggcaagaggtgggctcccaaagcctcgggcagctccacccctgttgctttgcgtacaatcctcagtcccagctgctttcacagctggtgttgagtgtctttagcttttccaggcatgtggtgcaagctgtcagtggatctacccttctgcgatctggaggacagtggccctcttctcacagctccactaggcagtgttccagttgggactctgtgtggggattccaaccccacatttcctttctgcactgccccagcagaggttttccatgagggctccacctctgcagcataattctgcctggacatccaggcatttccatacatcctctgaaatctaggtggaggttcccaaacctcaattcttgtcttctgcacaactgcaggaccaacaccacatgaattcttctaaggctgggggcttgccttctctgaagcaatatcctcagctgtaccttggtccctttaaccatggctggagtggctgatatgcagtcccaaggctgcacgcagtaggaaggccctggacccagtccatgtaaccatctttccttcctgggtctgtgatgggaaggacttccctgtgatgggaaggtctctgacatgccctgcaaacattttccctattgttttggagattaacatttggcttattgttacttatgcaaatttatgcagcaggcttgaatttctccccagaaaatggggttttcttttctattgcatcatcagtctgcaaatttttgataattttatgctctgtcacctcttaaacactttactagttagaaatttcttccaccagataccccaaatcatctctctcaagctcaatgtttcacagatctctagggcaggggcaaaaagctgccagtctctttgctaagcacagcaagagtcacctttgctctagctcccaacaagtttctcatctccatctgagaccaccaaagccttgactttattgtccatatcactgttagcagtttgggcaaagtcattcagtaagtctctaggacattccaaacttccccacagcttcctgtcttctgagctttcaaagtctctaggaacttccaaacattccaacattttcctgttttcttctgagccctctaaactatttcaacctctgcctattacctatttccaaagtttcttccacattttcaagctccttatagcagcaccctacttctggtacaaatttactgtattagtttcttctcatgctgttatgaagaaatacctgagactgggtaatttataaaggaaagaggataacttgactcacagttctgcagagctggggaggcctcaggaaacttaaaatcatgatggaaggggaagcaaacacatccttcttcacatggtggcagcaaggagaagtgcagagtgaaggaggttggggaagccccttataaaaccatcagatcttgtgagaactcactcactatcacaagaatagcatggagatagccactcccatgattcaattacctcccactgggttcctcccataatatgtggcaatcatgggaactataattcaaaattagattttggcgtgggcacagccagaccatatcaggccacatggcagtgcactgttggtgacctctaggttctgaggacagcctttacttgagatccagtgggaaactggctcagtcaagggaaggtaccccttgtcctgatctctgtggcctcattagtttggcagcctgtgctaacaaagctgaaagctgctaagaggtcaggacaactcccaggccttagaagcctgccctagggggacacagcatctggaccctctgccctggggtgactcctcccaagaatagttcctgggaagttgcccagcccttcactggccacacagatgcaagaaaacaagttttgctgacaacttgaatgaatctggaagtgtagttctccctagttaagcctccagatgagaatctagcccaactgacaccttgatgttagccttgtgaaaccatgagcagaggatccagttaaaccgtgcctgaactcttgatctataggaactggggcacaataaatacgttattttaagctgctaagtttgtggcaattcattatgcagcaatagaaaaagaatacagaaattatagaaacattaaagtcctatattacagcaactcttactgaaaatacaagtattggtgcatggacaggtagatcaatggaagagataatttcaactttaattttattataggagataacctagtatattacaaaacatcacaaattacatttaagtatccactcatgcctggtgtactatttactccttttctccatttgggaatcacggatacatcactgaaataaataacaggcagattaggcccattgtattgtgaaagttcaaatcacaggaaagctaaaataaagcatttttcaaatcttagtccattctaagcttgagagtgataaaaataggtcagagagaaaaagcctacatgaatatttaaaaaccgatcatcacaattttacaactaaaataaaatttttaaaattaaaagaatgttttcattaaatatgaaaaagtttaatatatatattatatagggagcaaatccaatctgtaaattaaagtgggtgcagagcataacttacaaatgataaaatgcaactagtaattgttatattgtagcatttttgcttatggaggaagaagctggtcaccaataaatattccttactttggtcaaagcctgaggagcatgagtagtgggcaactcaggactgaccctcagaaagttagtgacctggctcatcatgacagcccagatttcaatggtagtgaaagtcaaattattcttttaatataaaattccttttcaaaatgccaagtgcatgattgtcaagctggtaatcaaactttctgtggctgtttgcaatgagcaatgtccttgcttctcttgtaccattggaaaaaattcttctgctcaacactcaccaatcggtgctggcttgcttgaactttgtgtcatgcaagtgacaagcaggattctgtgagataagaagtaactaaataagattagtgtccttaatcaggactaatcaatcatttcaagtggaaaatttatttggatttgagtgacctgaagtgcattaacagcagattccataataatacagcaaatggtcatatttttacaatgctctacgatccccataaggagctaatttacttttttccttctgaatttttctaatcataaagattcaatcctctgtccccactgacttcccagaatggctttcatatgcatttacattcatgttaaatgtgtgaattgttttaatggcacttctttcacaacttgaaataattattttggttgagttcaccatgcttcaatatgttgtgtttgccccattctgagatttgtttaagagtgtagggtaagctgatgacatttcaaatagcctaatttgtctttgtatactgtatgttccaatcaaggacatttcaaagaatatgaaaattgtgtcagaaaatatgttatcaatatacaatcaatgtgtaaagtgtagaggcacgtttttccccaatattaatagttattttaaaaaaggagctctggcagagggtcacatgattctcctaatagctttctctgcaggcgtctccataattattctaccctgtggtatgccctgtcagtacagctaagtatgacagagccaatgaagtgatcaatgcttttcaggatctcttttcaactgagcaatgaatgattgctgagtgcagatagttgtccattggtgagtactctcattagtgacattaagcctgtgacaccagtgaatgaaaagtgaactgaggttgttgatggtcagcaagtcagctcccggcaagtgaaatattcattcaaaattattagccaactactgaggtctgcaatgacaactagggttactttcaatttctatgtaggtttatattttattagttattcaaggtaaagttaatttcaatgaataattcttgacagtggcagcttttttcagtactgtcattttaggcttgaaaaaacaaaaggacaaatcactgcctgagtgtgtatgtgagtttgttgtatgtttgcatgtaagtgagctttgtcatcttcctaggaggtacttacattattaagaaaaaatggacattttttaacagctaatattttgattgcttactataaaccatgtactctattaaaatgctttgtacagccagatgcagtggctcacacctgtaatcccggcactttgtgaggccaaggtgggtgaatcacctgaggtcaggagttcgagaccagcctgaccaacatggagaaaccctgtctctactgaaaatacaaaatcagctgggcatggtggcacatttctgtaatcccagctacttaggaaggctgaggcaggagaatcccttgaactcgggaggcagcgattgcggtgagccaagatcaccgttgcactccagcctgagccacaagagcgaaactccatctgaaaaaaaaaaaatgctttgtacattatactttattttctccttaaatttaataggatttaatgtgagccatggggctttggttaaaagtatattgaaattccgcaattcaaaatggagaagataggtcttaatagtaatgcatattaaaaaaaaagttaggattttagctaaatataatcatagtacaagccgtctactggtgtggttgtcaagaaaattaacatatagctgcgttattagtataacaactgaaaaataagaactatagtgcagatcagacccctgcaaagcaagtattcacttttggttgtgtatttttaatgggagactggtaaattggccaactactgaggtctgcaatgacaactactattgtagcccacttggatgaaagtaaccatatggtgggtactcaagcaaccctatcatatgatgaacagttcaagtaactttggaacttagctacagaaaatacatataaatcccatgaaaggtatcttcaagcacatttacacctgttcaacacagggactgtgttcctggaaagaggagtgtggatttcatcagcattataagaattggaacaatatggtccatatagatatctatggatatccaattgccccagcaccatttattgaaaagaccatgaatttttcaatgctctgaagtaccaactttgctctagataaaacagtgatgtattcaagtgtttagttctgggctctattttcttgcctgatctagttgtgtagttttatgctgacattgtatcacctcagttacttaactttttaattaggcttgatatctgataatattgtgaaaccttgttctttgactcttgagagtcatagctgttctggaccctcgaatcactatataaaggttagaataagatgattttgaggggaatatttgggattttaatcagggttctattatctatatatttatttgaggaaaattgacatattttcagtattgagtcttccaatccaagtttattcatccatttatttaaaacttcaaaaacttctctcaatagagtttataattttctgaaaggaggatttacatatatcttttgttgaattatttctagcagttttatattttgatgctattataaatgatatatttaaaaatttttattttttatttacttattgctactttatagaaatgcaattgatttttgtatactgaccttatttctaacactttgctaaactcacttgttaaatcaaaaatttatctgtcattttgtaggtttctcttatatacaatcatattatctgtgaaatgttgaaagctgtattccttctttctaatctttataccctttttcccctagcattgttactacactggcttctaccttcagtaaaatgttactcttggcaatcagcatagagttgtggttctctccataacctaaaaacaacctttattacagacgttagtctactgacatttgccaatattcctaacatatctgatttaaataaataatctcgctttctttttatcttttgtatattagatttttcttccatcttgttatcttttgtatatttttattatatggttatccaattttcagcttaaaaatatagattattttactatcattttgtttctgtagaattcttctcaatttatcaaagtataatgcgaattgatacttttattttctttctgagtaaggaaggggcttagaacacattaaatccactgtcttctttgttgaattacatgttacttttctgtcttttaatttttttatattttaaaatttaaaggatgttattgttttataaagtcaatattacatttttttgacctttgtttctagtcatctctccaattttatttgtctgaaggagcacctttttaatatttctcttagctcagatattctagtaacccaccttcctagtttttgtttgtctgaaaatgttattatttacttttacttttaaaggatactttctctggctgtagaattctagattgtgtcctagtgtaggtgccatattatttatcttattttgaatttaattggcttttaaaatctgtaatttatcatctttcatcactttagtacaacagacattaatttaaaatttgcttctgttccattcactctcttttcttcttctagaacaaaattacatgtatgttagaccttctcaacttatcccctgtgtctcttatcctctagatgtttcatcaattgtctctccatattgcaatatggcaataattttaaaaataagttttggctcagaaattctccatctatgtttattctgttgttgcttcaatctgtttggttcttaatttggtggtgtctttcagtcttgtaatttcatctcttccatatgtttcttatagattttctagttctttgaagaagctctaattttgtcttttatatccttgaaacatggtaagtatagtttattttacagcatatgtctgtttaatatttagaattcttaagaatttgtttctattgtctgtttttctgttgttttgtttataatgtctttcttctcttgggcctgattatttatttatgtgacaagtcactgtatttgaaaaattctggaaatattttgatggcagtgatgttatctttctccagagaggatttacattgcttctgatggacttcaaatagcaccagaaatttggatttcttaatacagtttaaggaattgatattatctaatgttggatgtagtccctctgtggcattatttctagtttgcccttattatgagaatgcagttctttgaggaaccaaaccaatttgtgggaatatttactaggcacactcttagcaggcatgatttccaatctttgttctcccttttccatttaaaaacatcagaaactgacagatttataaggggaaggcaactccgaatagtgggtttacttttcttcatggcattattagccctctaatgcctttatgtaaatatttttatgttttgtccaagtcttgaagttgtcctcccaattttctaccagccttaggagaaaactgggacttgctcaaagacacacacctataaataggagagttggcgctcaaacccagttcactgtagctctaaagtccatcttcttaacctatatgtgatactttcccactacatggttgttgataagtttcaaagaacaatgcacaatgattcctagatgtcaccagagaagtacggatgattagagactatgaacaccaatatagtcttgtagcaacatttgacagttaatagtagccagagttagacttcattcttttaggtttagtgacccagtgttgtcagcatgacagtgatttaaattctcagacatagtcacaatactaggttcatgaaaggtaatgtgcaagtcagaatgccagtgtatcaatgtataatttaaaaaattaagctatcctgaacattggaaggtttatgtgagacaactagtgatttctatgactgttgataaatgattgaaacaaagatgaactggaatcagaaggttctatgtaatcagaattatgaaatcagaataagaattattcagatgttacatagttacactaccccagtctccagtcatgagttcttaaatccatggaccaggacatcctctcctctacatgagtgagtgctgccaccttattaattttgaagtttcccttttcagtgtgctaagatagccaacccctttttaaatcagtcttgcctctatgaagaaatatccagaacactttggagatttggatattctaaaacttttcaattaaataatgaattacactcttattttagttttggaatagtcaaatatattgattgtgtaggaagactttttttaaacaataattcagtgtgcatctttatacaattccagataggtgttatacacattgttcttgtctgatatatactgagaaaatcaagtatttagaattttataaattctgtaaaaattgcttcaattagaatataatttaatattttgaaaactaatagtttcaaaaattgtgattaaagtcatatggatgtatatccttgtgtaagttaaaattatcattaaatatttattttaattttacttcctataattattacaatcaccgatgtaattacttctttatatattcaagttagacatttggcttttcaggattttgtttgtaaagaaaaagctttggagtagatgatattgaagatatgttcctgatctaaaatttcacaactacttcattaatacagattaggaagaaagtcattctactggctgcattttaaatttaggtacaatgcacatgtgtgctgccatcattagttagggctgggtgtagaagcatcgcctcttccatataatgatgcacttgagagctgagctcaattgtttagagatagaatgttaaatatgtctacgtctggtgcttatagattaacaaagtttaaatattgacaatttgaccatatttttttccagcaaataaacttggaaaaaagttggagaaagaatacaaagataaagaacacacatttttctcatgccttaaaaatgcagttccacccttataattgtgcagttattattatggaattacttattctcatggcagccttttgactttgctattgaaattttaaatcccctgttgctaccgggaagcatttattatacgcaagtataacatttttcctttgatttttgaagatgttgtttataaaaatttcatgagatacagtgtttctatacacattttaatatttgaaaactttttaatgaaccaaatacggaaggtttcagggcaaaagcaagttatcttggtcataaatatttcaatcttttttcaccattttccagtgtaagtataagcatttcttttagagattttagaacattctttgcatttttcagtcttcacaaattaaaatgactgaacaatggccatctgctttaactcagtacttaacttataatcttgtatttttaaaacttgtctctttaaagtgcgattgatctccattaacgtattatttctctgtgtatttttttcatgtttcacaatatacttagtgtttccacctgagaagaccaaagactatcctttgattttcatgctcctctacaatagctgaaactagtttgacctaagagtagttagcacttgagtttttcttgaaaataattatctaaaaaataatagccaaataacttatattctaaaaacaggcacacttaatctcctttacaactctagcaaatcagattttgaacatacgttaagcattctgaggtgtgggcaagtaatcatctgttctttcagtatttaattgcttttttaattgcaactgtgattttgacctccaatataaagcaagcatgacttactgggttactcagacagcagcagaagtgcttgtagatgaatgttatcttactcatcaaattctgacaaagtgtttagttaatttacaaaccacttgcacacagagagacacttaaaaatgtgttttcaatgaatggatctaataaaattttaggtaatatataattacaatggtaaaaatactgttttgttttttcatttcggaagtattaaggggtaatgaaaggaaatatcaattgcttttccactttaacccaatttaatctttacaacaaatcttttaattgggttttatgtaaagaaacaataccaaggctccaggtgattaaatacgtcaccagtatgtcaatgtttctcagtgtgtatgtgtttaggccaaggtttgagcctggacgtgtcttgttaataatcttgcttgtgttttggtaagctaattttaagtattttctaaaagcaagggatatatagtaaataagtacatccataaaattaacaaatcagaggaaagataatttgtcagaatctgtttaggatgtaacctgtttaggtagagcattattaaagtacatttgaggaatctacagatagaattgctattttctctttcctttctcaaccaagtcacctgccctccatcattcctttctcctcctaaagcctctctcagccaagagggaagtgctctggaactttgttgtacccttggaggaggtaaagcctcagagctcttaagctaatccaagacactctcatacagaaagaaaaatagtaagcaccttttggtacttcagtgcctatgaatagagcaagttcagaaactatcttgaacaaaactgcatgctgcatgtgacgtaggaactaatagagatatggttgaggtgaggaaaagggacaagtctttgtttctataaactacacctgctaatttggtgctaagatgaagccatttttaggatgaataaacacatctctgctttgtaaacgtacccgtttatacatttttttgtattacttgatagctttggtattatttcatcatttatctgttattgttaccctggctgcctctgctgttgttactgttttgaaaagtaacttgaataattatgaccaggaaattttggcaatgcctatgtcaagcagtggcagatatagtcatggctacataattaacattttgatcaatgacaggctgcatatatgatagttgtcccataaggttttaacactgtatttttactgtaaccttttctatgtttagatatgtttagctacacaaatacttaccattacattacatttgcctacagtgtttagtacagtaacatgatatacaggtttatagtccaggagcaataggctataccatatagcctaggtgtatagtaggatataccatctaggtttgcgtaaggatattctatgatgttcacacaaagacaaaattgcctaacaaggaatttctcagaagctatttccatcattaagcaatgcatgactgtatagtgaaccgtgaaaacttggaatataaaaatgttaggaatctactggagttgccattcttgctccaccttgtctttttcttgtaaatttttagtgcttctgtaatttagcattttagttatggataaatttcatatgggcatataatacatttacctttttacaatttaatttttgatttgtttgtacactgtgctcaaatgttccaaatacctttgttcatgaatccagttactcattcataatagtgtgatacatacacagctacccaaatcctaccccaaatcctaggagaattcccatgtggttctgttcagttttattttggttgaaggctgaggttttcatctggtgtctaaacaaatgaataatcctccactctcatgtcagagagtgtcagatagctggatactcaaaggtttaataaattagtgggtatccacatttctggacatttgagcacagtatctcctttacttagtcctggtgaggaaagatccttcttccattgtcacttcatggatcctgctccgttcacttgttcctgtctggctgaattgtcattctgtcaccacctcttccttttataactctagtcctaccccgcatatatctataatattctctcttgactagcattagtgttttttgggtcttatttttgtgtgggatggggaagaggagaaaccacctttggaattgttgaaggaaaaggtggaagtaagagaaataaacataaaatacacggattgttaattacagataagatcctacacatacttgttcaacaaatatttatcaaatgcctgttactactcaaaaatatatttaaatgctgagaatggcacacttttaaaaaagacaagttctctgctctctcaaaaatactatgtatgactttgagggaaattgtgagaaaaagagatttttttttcctaagtgtaatgggacattattatagatttttgagctgtggaattatatggcttatagtatgtttttggaggattagtttaggctataaggagcagaagtgatagctggattagattgggaggggtgattaagggaaatacaatcaaaggtaattaccttgcttttggcatttattaacccaagcagtaaatatttgttaagtagctactatgtacccctaggcaccagcagtaaatattttagtgctgacctcattacccagagccttgatgttttcaccatattaataaggaagagcacatccctagtttttattatgattccaaggtattaaagaatattatattaaatatgtgaaatgggataggataatgtttactgttctcatttgaatatttattctcttcaattgttgattagttaattattctttggaagagaaatttcgactgatgattaaaaaaacagttttttaaaaaaggcaaagaacttctgtggaatgactcttttctgtggtggtttttgaaccaaaatacagtagtccaaatgttttagtgaatgtttaatctattttatgtatttttgcatattttcatggttattcaatatataaatttctcaaggtttataaaatgaaaatgcaatttttcaccactttctaaaattttcaaatatttatagtatttttaattcacacactactgcatactatagttctacatgtggcaatggagcctcaactttgctcattgctgcaattcagacatttctgagaatccttaacaaaactcttgaaaaggctccattcattagcaggctttgtgtgagacactgagaggttttctggtaaaagtcaaacatacccacacaaaaactaattctaaaagtagggagaattaggcaagacagtcttaatattgatttctggtaatggcaaaatgcatattattcatttatgttttctcattcagaccattaaaaactcatgtaacagatttcaatggaggtgatttgaggtagggtggtggtagtggaatgaatatattaatcttgacttctaatttgattgcactgtggtttgagagactgttgttatttcagttcttttgcagttgctgaggaatattttactcctgattatgtgatcagttttagagtaagtgtcatgtggcgataagaagaatgtatattctgttgttttggggtggagagttatgtagatatctatcaagtccacttgatctagagctgagttcaggtcctgaatatctttgttaattttctgtctcaatgatctgtctaatattgtcagtggggtattaaaatctcccactatacttgtgtgggagtctatgtctctttataggtctctaagaacttgctttatgaatctgggtgctcctgtgttgggggcatatatatttaggacacttagttcttattgttgaattgaaccttttaccattatgtaatgcccttctttgtctttcttgacatttattggtttgaaatctgttttgtcagaaattaggattgcaaccccggcttttttgtttcctctttgcttgttaaattttcctccattcctttattttgaacctatgtgtgtctttgcgtgtaagatgtgtcccttgaagacagcatactgatgtgtcttggctcttcatccagcttgccattatgtgtcttttaaccagttgtcctatttacatataaagtaagtattattatgtgtgaatttgatcctgtcatcatgatgctagctgtttattttgcagacttgtttatgtggttgcttcatagtgtcactggtttgtctattttgtttattgttttttgtagtgactgataacagtttttcctttccacttttagtgcttcctttaggagctcttgcaaggcaggcctggtggtgaagaatttccttagcatttgcttgactgaaaagtatcttatttctctttcacttatgaagcttagtttggccagatatgaacttctggattggaaattctttcatttaagaatgttgaatattggctcccaatctcttctggctagtagggtttctgctgagaggtcttccgttagtctgatggggttctatttgtaggtgacctggccttttttttttggttgcccttgatatttttttttccatttgaccttggggaacctgatgattatgtgtcttggggttgattttctcgtgtaggatcttactgggattatctgcatttcctgaatttaaatgttgacctgtctttctaggttgaggaagttctcctggatgatatcttgtagtatgttttccaacttggttccactctccctgtctctttcaggcaccccaatctgtcataggtttggtgtctttacataattccatatttctcagaggttttgttcttttctttccattctgtatttttttttctattcttgtctgtgtgtcctattccagaaagatagtcttcaagttctgcgattccttcctctgcttgttgtattctgctactgatacttgtgattgaattgtgaagttctcaggtccatcaggtcagttatcttcttctctaaactgggtattctggcagtcagctcctgtatttttttaatcatgattcttagctcctttgcattgggttacaacatgccactttagctcagtaaagtttgttattactcaccttgtgaagcctacttctgtcaattcagccattttagcctcagcccacttctgtgcccttgccggagaggtattgtagtcatctggagaagaggcattctggctttttgagtttttacatttttacattgattcgttcttatctttgtgagcttatccacttttgatctttgaggttgctgacctttgaataaggttttcatgaggtctttgttatggatgttgtgttgttgttgttttctgtttgtttttcttttaacagtcaggccattgttccatagggctgctgctgtttgctgctgtttccactccagaccatagttgccttagtttttctcatacccggatgtatcactagtgaaggctgcaaagtggcaaagatggcagcctgctccttcctctggaagctctgtcccagtggagtactgatgtgttgccagcctgaacatccctgtaggaggtgtctggaggcccccaatgagagggctcacctagtcaagaggaacaggatcagggaccttcctaaagaagcagtctgggccgggtgcagtggctcatacctgtaatcccagcactttgggaggctgaggtgggcagatcacgaggtcaggagattgagaccatcctggttaacatgatgaaaccccgtctctactaaaaacacaaaaaaattagccaggcgtggtggtgggcgccgtagtcccagctactcgggaggctgaggcaggagaatggtgtgaacctgggaggcagagcttgcagtgagccgagatcgcgccactgcactccagcctgggtgacagagcgagactccatctcaaaaaaaaaaaaaaaaggcagcagtctggctgctttttggtagagcaggtgtgctgcactgggggttgttgggaggggagccatttgttgttacatttggactctccaaagctggcaggctggaatgactgagttgaccaaaccacagagatggtggccacaccctccccctgggaacatggtcccatctcaggcagactccagcctgttgccattggctggctggaattccaagccagtgggtcttaacttgtgaggtgctgtgaaatttgggcctgcagaatgatgctgcttggctctctggattcttccccattcctagggatatgtacagacagatctcccacctttttggggatcctggggctggagtatgtaaaactccaggatctctgtgtgtgcctaagcaactgctctgctgagactccacacagcaatatgtatcgaatccaaggccctggtgccatgggctcacaaggggatctcctgatatatgggttgcaaagatcggtgagagaagtgtggtttcctgggtgaggtcacacaatcacctgctgcttcccttggctgggagtcagggctcttttggctgtgtaccactcctgggtggactatcaccccaccctgcttttcttcattctccgtgggtcagcttgtttgcctaatcagtcccaaggtgagaacctggatatttcagttgaaggcactgaattcacttgcctctttcattcctctccatgagtgccacagactgaagctgcttctaatcagccatcttgcagaaaccactagtttcatttctttagcattaggaattgaatttcagtataatttagtggttagaagcagagatcttggctctttcaattatttaatctgtctttttggaaaaagtacatagcttctgtctgttttagtttgctcatccatatatggggttagtagtactacttatctcttaggcatattatgaatattaaataagttatttgtaaaactcctggagcactatggcacatagtgagcatatatgaagttaatcactcatttaaaaatattttttctatgagaagaaaagtctcttttatttgtatatcctcaattactagtgaggtaaatcatataggatgcccatatgtttactagtgaggtaaaacatataggatgcccatgcagttctttattgaactgcttgtatgaaaccaacccaatagtcccatagatagatagtttttttctaaacaaagaaatcgatcccactggtcttaaagctcaaaacttgcatttgttttatctgagttccttccttaggaaacaaacttcaggtctctcaccaaaaaaagtataaaaaattgaaactctcctgattaccacatccagacagtgagatgctggagtcctcattcatcatgattgcttctttttccctccctagttcctgtttttgttgtttttttcagacattgttaaatttcttccctactatataaactcctagctttagtgagtcagggaagtcaatttgaagttgagcttctatctctttggccatagcacctgattaaagccttcttccttggcaataatcattgtgtccctgattggctttccatgagatgagcagcaggacctaggctgaacccctagtgtcttggtaaaatgtacatgggtgtttggcgaatgttttaatctttttatttttgtttttaatagctctctcagctttctgtgaggtgagcaatggtgcctagactgaacccctggggttttggtaaaatgtacatgggagtttgggaaatattattatctttttatttttgtctttaatagctctctgagtgagagagactcctttagcccttgcatctaacttctgtttttcaaatttccattggcatactaaagaaaaatattatacatacactagtggtgtaaatcaggatacattacatatgaagcaatttcaattatgtttctgaaatagtgcagatgggataagagtgaggaaggcagagatttaccacctatataagaaaagctctaatatatccagcatgaagtgggtgagaactacagaggaggttgagtgacaaggcaggaagtagattttattaaacttcagaggaatgccctgatttctagagtctgcacagagtgttgataccataatggtaatcacaacctatatctggatgatatggtaatagggcctgatataatgtagtcctagcatatggtcactctacaaataggacttttgactggtgctattggtggcctatattttttattacttaaattatttaggtctcctaattgcaataaaatattaaatagtgtaatggaacttttttttttttgagacagagtctcacactgttgcccaggcttgagtgcagtatcatgatcttggctcactgcaacctccacctcctgggttcaagcgattctcctgcctcagcctcctgggtagctgggactacaggcatgccccaccatgtctggataattttttgtatttttagtagagatggggtttcatcgtgttagccaggatagtctcgatctcctgaccttgtgatctgcttgccttggcctcccaaagtgctgggattacaggcgtgagccaccacacccggctgaactattaattacattagctaaccactcacctatttaaacacaataaagctctctgtgtcatatgtcaggaaaatgtaactgagagatttatttgagaaattcaaaggacaagcattcatgataaataatacagaaattatatgaattgacttatccaagactgtcttgcatcattgcacatgatataaatgaggaattgaacattctgaaaattttgactttgttgacattaaaaagctatttaatatttgcttgttgaaaatatcaccaaaataatttgttgacaaagcaaatcagagtttattgcttaccatggaaagggaaacatttactttgatagagttttagtagtgtctcagaagagggagggcaaaggaaggatatttttgaggccttgagggacctggcttaaaaaggatcttttcaatgttggaactcgccttaatcagtttgggctgctataacaaattaccatagatggagcgacttaaacaacaaacttgtatttctcactgttctggagatttaaagtcctaggtcgggctgtcagcagggtgggattcttagtgagggttctcttcccggtttatgaatggctatcttcttgctgtggcctcacatggcagaaagacggctaactagctcttaggcctcttcttcttcttcttcttttttttttttttttttattatactttaagttcaatgtgcacaatgtgcaggtttgttacatatgtatacatgtaccatgttggtttgctgcacccattaactcgtcatttacattaggtatttctcctaatgctatccctcccccctcccccatccctctaccgcatgacaggccctggtttatgatgttccccaccctgtgtccaagtgttcttgttgttcaattcccacctatgagtgagaacatgtggcgtttggttttctgtcatagcgagagtttgctgagaatgatggtttccagcttcatccatgtccctacaaaggacatgaactcatccttttttatggctgcatagtattccatgatgtatatatgccagattttcttaatccagtctatcattgatggacatttgggttggttccaagtctttgctattgtgaatagtgctgcaataaacacacgtgtgcatgtgtctttatagtatcatgatttataatcctttgggtatatacccactaatgggatcactgggtcaaatggtatttctaaaaggacactaatcccattcataggggcttcaacttcatgacttaataacctcccaaaggtctcacttccaaatgtcatcacattaaaattagaccttcaatgtgtacattttgggagaacacaaaccttcagtctattgtaggagttcattagaattgggcaagcttcaggatataatattttaaaagtgatagacccagagaagcaaggattttgaggcaagagttcctaaatgagccttggccagtcaataagactaggtgggctgtccactatttttagatgagtactttcaaaaggttcctgaaagaacaattgaatatttctgcaattttactttcctgggaacagattgctaaaataataaaataatgttaatgtcagtgtaaagctgtgtgaatgttgctagttttatttctcaaagcagtacatttgtagataaaatatctatttcaagcaatgtaacaaggaacaaatgccacgagaataatttaacagacctaggagccaatgcagagaccagactctggttttaatgtctcctctacaaaaataaacattatttgtttgaggggaatcattgcatttgatccattacttccttatcaaagatactcatatgcttgattttctccatttacgaggagtttgctgcagttggaaacagaggactgaaagggactaatagagtcttgatggctttggctcttttgtttgtgtttaagagcatcacaggaaaagaaaattagggagattttagtattaaaaagagctgtaacttttcaaaagctattcaggcatgatttagagttgatccagaatataaataaagtgatatccaatgacagcagtcaaataatatggtctataggtatatatagtgtttgctctcagtagtttattaagaatcatttttaatatcaactttatgcataatttatttacaattatttcatccaattaaagtaaataaattgatacaccaccaatattagacaaaactgtgttactcccaaaaagtttcattatgcccataggcagtctatccccccctttttttctagacccaggaaactaccaatttttttttttggtcagtatgattagtttccaattttaagacattctgtataaattgagtcttacaaaataatttcacagtgtctagtttttttcactcagcatgcagattttaatgtcatccaagttttgtggtaatctgttactttttaataatgaatagttttttattgttatgataatacaattttttttcattcattgtgcatttgggttgatttcaattttggatagtgaataaaggtgttatgaagatttatgtaaatgttttcatagagccgtagggctagaatggctagattgtatagaaggagtaatttttataaatattttaagaaataatcaaattgttttctaatgtggcagtaccattttacatttccattatcagtatatgagagtctcagttaccttcatattttcaccaacacttagtattgtcagtctttttaatatagctattctaataaatgtgtagtagcatcacattaaaaatttaatttgcagttctctcataatccttgatattgagaatcttttcgtggacatattgacatttgtatattttttcgcttattgatttatcttttgtgtatctgtacaaaactttggcccactttttatatagttgtttctttttttattgagttagaaggacttcttattgaacacacatattttgtctcacaaatgtattgcaaatatttttccaattctgtggcttgcattttaattttttaaaaaagatcttttaaatagcgggatacttttattgtaataaagtttaatttttcagggttttctgttatgctttgtgatatttgtgttgtaattaagaaatacttggctaacaatagatgcaaagatttttctcatttttttcttccagttttaagttttaaatttagatttctgttccattttgggttaatttttggatacaatgtgaagtaaatgtcagtgttcattgtttccatattgatattcattagttccaaaaatatttgttgaaaactattttcctttccctattaacatttctcgtcatccttgtcaaaaatcaattgagcctacatttctgggtctacttcatttatgtgtgtatctgtcctttcatgaataccacattgtctcgattggtgtagttttataataagcctggcaatcagatatggtaagtcttccacctttgttctttttcaaaattactttggattttctaggtcagtgtaatacttaaaaattgatttttaggtctgggtatggtggctcacacctgtaatcccagcactttgggaggccgaggcaggtggatgacaaggtcaggagtttgagaccagcttggctaacatggtgaaaccccgtctctactaataacgcaaaaattagctgggcgtggtggcacacacctgtaatcccagctgagggatagcgaatcacttgaacccgggaggtggaggttgcagtgagccaagattgtgccattgcactccagcctgggtgaaagagtgaagctccatctcaaaaaaaaaaaaaatagatttttgatttcccttttactttctgcaaatgattatttaggatttgaatcattttttagttaaatatgttgtagactttgccagtgttgtgaacttgttctgtagtcttctttatggaaagattttaaattataatttatttatcttaatagatattggactatatacttctctgagctaaggtagtttgagtctttcattaagtttgtccatttcactaaatcttcaaaatgttttttggtcaatgttaataatattcacttaatattatttttaatatctgtaggatctgtagtgactattttttctctcattcttgatatcagtagtttgcttcttttttccccttgtcattgtgtctaaaagtttgccaatttttaaatctttcacccatttttttttgctttcatatattttctcttttcaattacatttattttcttctttcctcttgttttgtgtttaatttgctcttcattatcttatttcttaaggtggaggtttacattattgatttggaacttttattgttttttaaaataagcatttagtcttctaaatgtttctctaaatacttatttagcttcatcctattgtttttgatatgttgtgttatcattttcattttttccataatattttctaatctttccttattgattcttcttgacaaatgggttatttagaagtgtttaatttttacttatttgagaattttctagctatctttctggtgtgtatttctagttgaattcccttgagataagagaacatacttcacatgatgtgttttttcagaattttgtttaggcttgtttcatgcctacaatatcaattatcttagtgaatgtaccatgtgcatttgaaaaaacagtgcattctgctgttattgggtggactattttttgttttttttgtttttgtttttttttttttgagatggagtcttgctctgcctccaggctggagtgcagtggcgcgacctcggctcactgcaagcttcgcctccctggttcaagcgattctcctgccgcagcctcctgagtagctgggataacaggcgcgccaccacacccagctaattttttttcatatttttagtagaaacggggtttcactatgttggccaggatggtctcgatctcttgacctcgtgatctgcctgcctcggcctcccaaagtgctgggattacatgcatgagccaccacgcctggcctggatggactgttttataaatgaaaattaattcaaataggctgataatgttgttcaggtgtcaatttagtctctaatttttctgtctatgcattacttagattattgatagaggattaattgtagtttgtttattcctccttgcagttctatcagtttttgcttcgtgcattttaaaactctgctgttagatgaatacacacttaacatagcagcgtcttcttggtgaattgattgtcaggcctctgagcccaagctaagccatcatcacccctgtgacttgcacgtatacatccagatgacctggagcaactgaagaaccacaaagatgacatttcaccattgtgatttgttcctgccccaccccaattaatcaatcgaccttgtgacattccccccggacaatgagtcacatgatctccccaccctgcaccttgtgacccacacccctgcccgcaagagataaccacctttaactgtaattttccactacctacccaaatcctataaaactgccccacccctatctccctttgctgactatttttttggactcagcccacttgcacccaagtgaaataaacagccttgttgctcacacaaagcctgttggtggactctcttcacagggatgtgcatgacactgatcactttatagtcatgtaatgtccttctttatcttgacaatattccttgttttgttgtctgcttcacctgcattaacatctgcccgagcttgctttttattaatgtttgaatggtatagtttttttcttttcattttatttttaaactatttatgtctttatatttaagtgggtttcttatacactgcatacaactgaaccctgtgtgtgtgtgtgtgtgtgttttaattcaatcagataatctctgtactttaatttaggtgtttagaccatatacatttaatgtatcactgtggttgaatttaaatctaccatctctttggttgttttcaaaatgttccatctgtttattctttggttttctttttctcaatttaggtctccttttggattgattttaaaatgattccattttaaatgattctattgcctcattggtttattaaatctttacaaaaactttttagtggctacttagaattgacaatatgcaactttaatttattacactctaccttcaaataatatcacctcacatgttgtgtttgaaaactaagctctgattttttcttatcttgcccaaattcctatctaaggggtctggggagtcatgccctacaaaccataaattctcatcagatgggttttatttaacactatatatcatgacttactttccagtctcaccctggcataacactatgtgacaaagaagaaaatcaaaatattttattcccaaacatgtttctttgcgatattttaaaatggcgctactaagccgtcctttgtgggaacaaatttgcacctgtatataatctctattaacatagctagatctttttcttccaggccctcctaatcctgaagagattaactaagagtctagcaccttttaaaggtctgaacaggaaacatttgtcatctattacctctatgggcagccactataagacttcaaaagaaccttggtctccacaatcttttatcttaacctgaatatttcctttctattgatcccaggtcttcagacaaactcaaccaactgtcaaccaaaaattctttcaatttacctatagcctggactccccaccctcttcccctgcttttgacttctggaccaaaccaatgtatttctttttttttttttttttttttgagacggagtctgactctgtgtcccaggctggagtgcggtggctggatctcggctaagtgcaagctccgcctcccgggttcactccattctcctgcctcagcctcccaagtagctgggactacagtcgcctaccaccacacccggctaattttttgtgtttttagtagagacagggttttaccatgttagccaggatggtcttgatctcatgacctcgtgatccgcctgcctcggcctcccaaagtgctgggattacaggcttgagccaccgcgcctggccaaaccaatgtatttcttaagtgtatttgattggtgtctcatgctgccctaaaatgtataaaaacaacctgcatcctgaccaccttgggcacatgttctcaggacctcctgagggctatgtcatggcccatggtcactcatatttggctcagaataaatctcttcaaatgttttacagaatttgattcttttcattgacatgttaaaggattacaacagtatatttccacttatctataatttataccactgttttcatgtttcattgtatatatgttgtaaaacccaaaatactttaatattatttttgctttaaacagtagtgtcttataaagacatttttaaaaagttttaaaatctgtatctttattattttatcattcccagaactcttcatttctttatttagattcagtttctgtctggtattataatccttctactggaaaaaattgagttaatatttcttgtagcacaggcatgctgacaatggattctctcagcctttatctgaaattatgtttaacctttgtttcttctttgctttgagagatgttcccactaataaagaagtctggatgaacaggtttttttttcttctgcacttgaaatatgtcatcccattgtgttttgatttgcataatttttgatgaaaagttactgtattgtatgtaaaatattcctgtattgtatgaaatgggtcatttttttctgtctgctttcaagattttcacttttaaaaccttttctttagtcttcgtatgatgtatttagttttctttctttttttcttttctttttttttttgagatggagtttcactcttgttgcccaggctggagtgcaatggcacaatctcagctcactgcaacctctgcctcccaggttcaagggattctcctgcctcagtctcctgaatagctgggattcaggcatgtgccaccatgcccagctaattttgtatttttagttgagacggggtttttccatgttggtcaggctggtctcgaactcccaacctcaggtgatccacctgcctcagtctcccaaagtgctggattacaggcgtgagccactacgcccagccgtatttagttttctttttaaacaatacttatgttgtgtttttttctaagccttttaaatgtgtactttgattcctttagttatttttgaagaattcccagtcattatcttttcaagtatttcttctgccccattctctttctcttccccttttgagatttcaattacatgtgtatttgatggtttgcaattcatccacagatcctgcatgctgttgatcccatcaaaggcattcttcttatctgttaccatgctttttatttctataatcactgcattaatcatatggatcatatgtgggcctgattcttcctattgccttgtcttctagtagtgtgctgtttttccttgctttgttgtgtttctcaaattttgtacttgataagctgatggtatgtataagatacatacacatgtatatgtatatgtatacatataaataaaatttattgagtcttttttttatttgtgtctagaagtggggctaatttctctctttgttcagtttttatcatgagggattgagctaatatagtcagaagttgagctagttttatttatttatttttattcttatggttatcctcagtgcactgctgatttcaaattcctctagtgttgtcttttacttagagtggcagctgagtagcaagttttcctcaatattcctcttacaacctcagctttagggttcccctgtgagtctgtgcctgtgagaggttcttttcttttcccatgttcttgtacttttctcagcaggagacttctgttacttgcttcctgttgcttgctagccttgtgttggtgggtgtagggccattctctgctacctgggttcagcctcagtcttaggcaggtccctgggcttcagagatggtactttctcagtgattctggccctaatccagctaggattagggtttatttgtctccttaccttagtttgcagttgtaatgggtccccacctacatgcttttacccttgggcttaagcttttgtttcataatagggatagggcaaagggatcatgctttccctcagtgtctgttccttccctttttcaggtcttttagtgagggagcttttgtaatttcagcaatgggtctctcatctaagttcctggtgagatccctggagaagagtttgtgaatgggtttgaattcttgaatctgaggctctgaagggttttataatctcattctagctcacactcatccccttttagaaattcaataatactttttagctgggtttttcttactgggttataaagcacccagtgcctcttcctcgcatgctctgtctgcctcagcttatgctcctctgtccttggagacacctgacttttcttaggtatcagacaagatttttgctgagtaaccccagccctctgatttatgcaagaaaagttatgcttttgaagattagctttttctgattgttagaaggtgggagaggcattctttccagctttttacttgctaagccaaatgcaaatacaattttgagaagtagaaaaagaaagtatattggcaaaagtctacaggctcagaaaagacattatgttgtaataagtatatgaagatattgctgaaacaatgataactgtgttaagattttcagatgttttccctagagcaatgtgaatattataaacctgcttttaaaggccaaaatactatttattttcaaaatgatgattttgtgaaaaatgaaaaaaaatttaaattatgtgattatttactgaaaatacaaatgataaaattgattttaatctataaaacaaaacaaaatattataatgctatatttcttatagtaggtatttagtttttgagtaatccttaagggatggctaggtagatcctttacgagttcattaattattgccttcatttgaaagcttcagttgcatgtaacagaaaatccaacttaaactaccttaaatagaaaagtgaatgtgctttctcataaagacaagaaactaaagacagtaagattttatgcaaagattgaaccagaggtttataatgtttaacaggactccagtgatattcctctgaaccagtcattgtccccaagaggatgcagtgtacttcttggattgatttaaattacaggactctttcctggaagtggcagttaattcaacttcctgagaatgaaacatattgtaaatgaatatcaggaatatgtatgaggcaaaaaaaaaaaaaaaatgttagtgaggcactccccagtatctattctacacacacacacatatatatatacgtatatatatatatacatatatatatacgtatatatatatatatattttttattgcccaatacatataaaacaccaaactagacatattgggtgtttggaggggatgaagagaaatcactgtttacttttaaaaactagagcaaaatatgagaaagcattttgttgaagaacgttgtaagaaaaatgattcagagattcctctattgaagtacattcttttttttttttttttttgagttggagtctcactctgtcgcccaggctggagtgcagtggcgcgatctcggctcactgcaaactccgcctcccgggttcacgccattctcctgcctcagcctcccgagtagctgggactacaggcgccagccaccacgcccggctattttttttttgtatttttagtagagacggggtttcaccgtgttatccaggatggtctcgatcccctgacctcgtgatccgcccgcctcggcctcccaaagtgctgggattacaggcgtgagccactgtgcccagccatgaagtacattcttgagaatctcaggattttagagcttggaattacctgagagatcactgagtttacctttctcattttacagatgaggtaatggagaccacagatgctaaatgacttgcaaaggtcatgcggtcagcaggtggtgaatcctaggcaagaacatatttttggctttgagactgcagctctttccattactccatatttattttgaaacagagaaaaaaattctgattagcttatatgcacataaagtcatttgtcaccatagaatagccttactgcagtaatacattgatggcaaaagttccatcctccttttcaaaggcctagtttgtatgtgtgtctgcttatgaatgtaactttagattaaagtgcttattagtttttttcccctttgtttcaaagacatttttcaaatgttttacctttgacactgccacctgcccacacttatgaatattaaataatgttagaggttaatgcactactaatgataggttgttgtaactcaattggaccctcttggcaagaaatgctcaataaaatgctctttctacagcaaaactaagtggtcctggttatatcctgtgtgattgaggaaaataggattttattttggtatatctgtgtgacatatatgtctttcaggataatataaaaagagtatgtatgacttttataaatcatttatgagtttaccacttttcatagatattactcttttagtagtgcttgtttttaaaatatcatgccaagtaatttaacttttaatattgttaaattgaaaaattttaaaatcacaatgaaattgttttacatgttaattatagtaatagtagctatattatgataaagattattaggaagaatctaaattttgacattggttttactagttttctattactaaaaggtttcattaattctacttctctttataataaaggtaaaagtgtattttaaaaagaatggcctgtaaactaagtctttttgaaaatatatcaaaatacagaatgtgatataacagcagaaattgagcactgttattgctcttggaattttggtgtgtaaaagtaaaactgaaagagaatctctatctttaaaaaactgacaatctgttagaagaaatatggcatgaacatataaataactatacacagacaaatgtgatatgaactgtatgagtaatacccagtaacttcagaatacaaaggagaagagatgactttgactaagaagatttacgggaagcttcataaagaataaactagttgggctaggctttacaaatgcttagttgataaaaaagagaaacaaaagatgtaaaggcaagaaagatcacagcatttcagggaaaggcagaaaatatcatttggtgggagagatggatctatgaagtgaagtcaatggaattagagattgaaaaaagggtaatttgactaggaatagtggaccacagacatgattctgtagctaatgctggttattaaaagtatgagcttgagagctcatagtcatataatctaaatatactttaagaataatttttttgtaactagatataggatggacttgaatatgtgtgttagtttagaaaggcatagaaaaaaatctaatgatgttatcacgtattccaagcaagagataataaattcagttctggcaccagaaaatggaaaagaggttaaatataattagcattatagaaattgacttggcaagacattgtgactaactaatggtttgtctggatttgttggggattaagagacatatttgagaaaaggtgtccgttactttaaggaaggttggaagacggaagactaaacaagatattgagttagtgatttgaagatgcttctttcaataaagaaattttctcaattgtatagagtcataggggtgagactatattataaagaattgaggggtaactgaaaggtgagaaaatggctttggaattatactttacttttttttctcaaagaatttaactttttatttccttctgtttaagtttttatactattggattattagtgttgaaatgctacttgttcatacaaaatgtctttcattagtaacatgtaggtatttgataatacagctaataaattcctgaaaaattagatattcagatacccagccttagcttacatatatgaatagggaattcaggttggacaatatttctatttctcctattttattgtatttccatgaatacaaatgtaaaaagagtacacctttataccatttctatttttaattacttagttcttctggcacaccctttcaaagaatgtaatgtttctatttcacttaattgctgtttaattaatatgcagttcataagtgaggaggataaatgtaataattcacaaaagataagtaagccaaacactgtttgttcattccttctgggctatgatttgagaatatgcaggacaatacacgttttataaagattcaaatgagattatttcctttggtgattctctaatatattgtctcttaagaatgctaacttattttgaatgactgtcttgtgtggcaaaaataaccttctaagttaagagtatataatgatagatgacttaatagtacagtgttcaccaatatcctatgatgatgaggaagtgattggaaagacagtaatccatctggatatagtcattttcaatatcctactgaattaacgactatgcatttttagtggaacacatttatatttggatgtagtggatgtaagtgtctacaacagcattcttaactttctgatcttcaaaattaattttagtagaagacttggtttttccaaaagctatcttcatttgtctgtaaaatctacactgaatgaactcgtgtaataaatttactgattgaatttgattaatttatttaatttttctctttagaaattttcttctaaatcaggtaatttaaacaattagattgagtttgttacatatttttaaaaatagttaaatggaaacattgtaatattatcacaattaatttgttatttaaatgatagcttatgacacattaaactttttctagtgctgggattctttttagaaagttaggctgtgcacggtggctcacacctgtaatcccagcactttgggaggccaagacaggtggatcacctgaggtcaagagttcgagacaagcctggccaacatgtgaaaccctgtctctatgaaaaatataaaaattagccgggcatggtgctgggcacctgtaatcccagctactcgggaggctgaggcaggagaatcacttgaactcaggaggtagaggttgcagtgaggtgaggtagtgctactacactccagcctgggtgacagagtgagactctgtctcaaaaaaaaaaaaaaaaaaaaagttaatctagcctcatagagtcttttggaacctatctggcttgtagttacttggcagatatattttctttaagccaatatgcccagtcctgtatttagacatacagtttatggcctaattcttacataggttacaacaaattcctttccttaggacaattctataaagtcttctaccagtttcatctcccttttaagatgacataactgcacacatgtagcattgctatggaggaatatactcagtatggtgagaatcagtcatctggttacttccatctctaacatcaactccagaatatatgctaaactcttcttgtgaatccttgtcatctaatagccctgtgctcattttgtctcagggaactaggctttttaagtcatcttgactcttgagtctttttctataatccatgttcaatagctcagcaaacaaattctcagaattccatggatcttaaatgtcaaccaagataaaaaataaagggagttccattttcttcagggactgggtgactaaatgtaaatgatcaggaaatacagtcttgagagttgttttactgtttactagcagaatagttatgactccagatcctgtatccttcatgtgtaaaggaggtagagcaattttacataaatttttttttgcattaaaggtggcattttatgtaaaagcacacacacacacgttcagcaattatgaaatatataggacatgtgtgtctataagtatacctataaatatgcgtaggaaaaagtcctccaaaaatgataatacttgtagaggatttatagttcatgaagtgcttttctaaatactatattgttattatgcgttatattaatttaatttttacatataacaaatgcagatggttatatttatttcatattaatctgaagaaaaaactatgacaaagaaaatttaaatatggaggagcaaagacatagcaagagaaatagtcaggatagaaatttagatctacttatttcacctctaactctagtctgccttctatctgggaagaacaacttggctttatctatttccagtaatagggaagttcttgcttgtcccatgtctttagttcagttttagtatttatttctgtgatcaatttatggctgcagattccatttacaataggactttgatgaacccagggattccataatactggctcagtgtgtgtgtgtgtgtgtgtgtgtatgtatgtgtgtgtgtgtatatatatgtgtgtgtgtgtatatgtgtgtgtatgtatgtatgtatgtgtgtgtgtatatatatacacatatgtgtgtgtgtgtatatatatacacatatgtgtgtgtgtatatatatgtgtgtgtgtgtatgtgtgtgtatgtatgtatgtgtgtgtatatatatatatacacatatgtgtgtgtgtgtatatatatatgtatttcccctctcctatctattttgctgttcatttttatcttctctgttggctcctcttcctgtatctgactgctaaatattggtacttttcagagctaattattttactttttaaaaaaaattctcttcagtttttgctaggtcaccaatgatttagataagaatctatatgtcatcacctcacagatttgtaacgccagctggtacctctcttctgagctccagatccatttatcaattctgaaatttgatgtctcacaacctcccacattcaaaatctccaaaacttagctcatgaactctccaaaacccctttgaattcgaaattgctcctcccacagttgcaaaagccagaaacctgggcgttaccactatttcttctcctttcatatctactccttccaattcatcactaagtctttggctttttcctcctgattgtatcagggactaaggatttttaatgtatgaataaacacaatcttttcttctccctctgacttctagaatagatgtatgcttatttcttttgtgaactcttggcaacttatttactgtatagaacttaggaaaatggctaattcttgcaggaaatgcaataaaggatccctgagtctttccattcgtgggaaacttgggttgttgagagctaatttttcggccacctttgtgcggcaacggacagatgagaatggaaatgctgatgaacattacctgctaggaggagatgaataagtagcatggcgttgtgtggtggttagggagtgggccctgtgactgtgagagagctgtgtgttgagaggaaaatctggctgccaatgttgaaacttgagttgtaaggcagtttactggcagaattcgttcctacccagagtacctcaatctttcttttcacttgaggccttcaactgattggatgaggcctactgacattatgagtatgacctacttttctcaaagtctactgatataaaagttaataatatctaagaaataccttcacagtaacgccgagattgctgtttgaccaaatgacgggttactattgcctagtcaagttgacatatacaatcaaccatgacagagaggatctattctattttcacctgattcagttccagtaattatttttttgtatcttatatcctagagatctctcagggtttcttccctcagccccagatcttctcccatacttatatataagaaacgtcttccatttcctatgtctcagtttgaatgtagctttatcagaggagtctctacttttctaaggattaggtcaattcctctgttagatgcttccatagaaccctctgctaatcatttgtttaaaatctctgttcctttctaggaacagagaacacaataggcatgcagtaactattaaagtaatggctggatctaccttagaacacacttaacctgcactgttggttccatagctttctgctttgctgagagtgacatctatggcaattttctctatcctcctcaccccttaattacaagttgagaagctatgtttgtgggtggggcaggtccactgaatgactatgttggatattgagataagcaaacagactaaaggcttaggttgcgcacaacgctcactttatcactttttagctttttcttctctctttcccgtagcagctggtacaattagagggaacagaggctattggcatagcttgggccccaggtaggaggggcccaagcttggcataaatattagaataagctcttctgtgaagctcttctcaggctttagagcacatggtttttaaaatttttttatttttgtattattatttttttaactcttactttccttgattttttttctttaatgcttttttttttttccctgtccaggttcatgttagcatatgaactaaaaaatatcaaaaaggaagaaggactgctgtattgtcatgttggcagatttattcatttcatattgacaatgctaatttattatactttcaaacccatcttgccctcagggatgttagatgatctggttccactgctattaaatgcttgctcctgtaaactttgtggacatagaggctgagggaacccaataatttaatccagaagtcaaattatcaggcgcctttgcccagtggtgtttctgttaaattcacaaaaataatttatgggccaggtgcagtggctcacgcctgtaatcctagcactttgggaggccgaggcaggtggatcacctgaggtcaggagttcaagaccagcctggccaacatggtgaaaccctgtctctactaaaaatacaaaaaattagctgggcatggtgaaagtcacctgtaatcccagctattttggaggctgaggcaggagaatcgcttgaacctgggaggcagaggttgcaatgagccgagatcacgccgtggcacaccagcctgagcaacaagagcgaagctccttctcaaaaaaaacaaagtaataatttatgcattgtgaggagatgcctataacctactaaacatcatattcacaatagcatggcctcttcacctaaagtgtgaaaccttcagattaaagcaaggttaattacgttttctacagtgtcatatttctacaaagtacaaaatgcaaagcaaaataacccagaagctaggaatgagaatttttattctttttttaggactaagacgttggttagttttgatttgaattcctggaaaacctagtgctttcttaagataatacacttgacagcctttattaaacatactaaatagattagaagataagtttgtgcataagtctgtgcttgttttggatagtttcctatttgagtgttgtcttttttctaatattccttcactctgactagattagatgtctctcttctctcctattataacaatcaataaatagctgttattttttactcatgattttgcatcatatttactagagtatgtgtctacgtcctcttttaactgcctgttggcaattgcctgttgcatcttattcactgagcaactaggcctatggcaaacaatcaattattagcatctgaatgaccatatatatatatctgttctcgtctttttttttgagacggagtctcgctctgtcgcccaggctggagagccgtggcacgatctcggctcactgaaagctctgcctcctgggtttgtgccattctcctgccttagcctcccgagtagctgggactacaggtgcccgccaccacacctggctatttttttgtatttttagtagagacgggggtctcactgtgttagccaggatggtctcgatctcctgacctcgtgatctgcccgccttggcctcccaaaatgttgggattacaggcatgagccacaacgcccggccctgttattgtctttaaaataccctgtgcttcctttcttaactgaatgtaacctcagaggaagttaggtaacagatgttaggtaattgggcattctctgcccctggaatcatccttacactctgaggcattcaggcctttccatgtacagggactattttgtaggaaatgaaacacagtggctgtattagcttgggctgccacaacaaataccatagactgggcaacttaaacaatagaaatttatgttttcacaattctggagactgggaagtttaagttcaatgtgccatctgactagatgaagtccctatttgtggcttatagccggccttctccctatgtcatcacatagtggagacagaaagaagaatagctctctggtgtctttttttttttttttttttttaataagaacactaattttatcagattagcaccacccccaaccttatgacctaatttaaccttaattaccaccctactccaaatacagtcacgttggttgttaaaagtttcaacctgaattttagggtaaacaattagatccatagtggggaattgaagaatttttaatataatttcaatttttaatgctggaaagcatgattacatatgaagcaaactcagcaaaatggccaatgcacaccaggccactttccttccacacatgcctgccttttagctgagaagaggataaggaaagcaaaatgcgtgttccatccagttctagaagttagatgttgactttcagaatacaaaccagaaaacaggttcagggtgggagaaaagctcacagaacagagatgagaggctttgctgcttctgactctgctcatttttcttccctttttttttttttaccttttcctctccacacctttagcctgcaaagctctacatggtaatattagcagattaaaaggaaatttgagagaagacaagtttaaatgccagaaagcagtgaagcactggataaagtgttaatcaaagcaagcaagaagcagcagctcaggatatacttggaagcagacacagcttccttaactacatagctttctcttcgtttgacatttttatttccagagtactacttgagcctcaaaagcttgctttttagtgaggaaaaaaattaaaaggtttattcaaccttttagggtgaaggaaaatgttgagttctctgagcatttccttgtgcaatgagtcttgtatatctaaaccactttggtttcctgttttaatcttggctttgatatcacatggtcctttttaaaatatatatttatattgtttaaaactaatttttgaattttcatttggtttcaaaaatgaatctaaggactggaaaattttctacaatttacaaaagaagaaactgaggttcgtagtttatgtagtgtgcatgagatcacgtgtctccaagtggttaaggccatgattcatatccaagagtgactgactccaaagactgtgttgtcttttcatataaaatacttcgatgtgtaccaagaaaaacatttatgtttcttcacttgacaagcacaagtcctgtctttataaaccattagaaataattatagccttcacagtggggcagaaagcagttttctactttgatgtatgtcttgtagggaagaataacattttaactatgattttgactttgttcttcattagtttacctcatgttgagcattttgtcatgctgattccctctgaagatttttaatgcaatgcgtggtgccacaaatttgattagagtaactggcatttgattgtgccttggctcaaactttcctccttagtgccccaggtgctagtttttcagattcctgcagtaatcaggaactaaggagatttgcactcttgacaccctaacaggtaaattaacttcgtgatctgtcagattccactggagtcatcataattctgactgttgtgacatacaatccttgtaatgttttctaagtggtttgaagatggatggcacataaatatgtatgtctaaagatgagtataacattgttatgcttccctttgcatatttgctataggaaaaaaacactcattttgtcaaaaattctcaagaatgatcaacaacttttactgcaaaatagtgtaatatgctatataattgttacttaagaatttctaaaacaaagttacataactcatgaatattttacgtggaaggcatatgatgctggaaagacttgggggcaaatattggcttttcaacatactggctgtctaggcacaagtaagtctgagtttactcacttttagaaagtttaagataaagttttaggctttatttttaacaaatattactagactactaactacacaaggcactgtgccaaatattttaaataaaatagtgaacaaaatagagaggtagccccactctgatatggcttacagttgtaaattttagttgaataaacaaataaatgttacacaatgtgacaagttctatgatgtgtagtatgaggtgtcctgggagcaagtgaaattaatcccagctggggttaagacttaaaacatgagcataaattagctaagtagtgagagagagtgtattaccaaagacatgaagctctttagaggtaggcagaagcaagattatgtggaaatcagaatacatattaggagtttggactatatccaaagatcaaacagaagccacatagagtttgatttattcatttgttaattcaacaactgttcatcaacaaatgtattagacactacttttggttctaggaacatagtaataaaaaaaaaaaaaaaactcctgggccaggcgcagtggctcatgcgtgtaatctcagcactttgggaggccgaggcgggtggatcatgaggtcaggagtttgagaccagcctggcaacatggtgaaatcctgtctctactaaaaatacaaaaaaattagccaggcgtggtggcacacgcctgtaatcccagctactcgggaggctaaggcaggagaatagtttgaatctgggaggcaggggttgcagtgagctaagatcatgccattgcactccagcctgggacagagcaagactgtgtctcaaaaaaaaaaaaaaaaaaaaaaaaaacaaaactccaaattttgacccttatgcttatatgccactgtgaaaagacaacctcaatataaaaaatacatgattatatttgaaggaagaatatcagcgctattgtagaaaatgttgttgttgttttaaaaatggagaaaggctaggggtttgtcagtttagaaaaaaataatctagaatggctgcagcacagtgagcaggtaggagagtgatagcaaaagagcctgagatgtcaccagaggcctctgtgggacagatcactgtaaagacttaaacttttactgtaagtgaaatggaaagcctttgaacattttttggcgggtaaataatattatctgatttatacttcaaaggaatcacttggctattgatttaggaacaatagtagggtggcaatggtagatgtcgaaaatcaattagagggccgtcgtcaatgctaagatgagtgatgatgaccaggatgaatttgactggcttcaaaggcaagtagtggaaatattcttggatatatttttaggttagatcatttaattatttcctaacatgttgaatgtgagtgacaaaatagaacattcaaggaagacactcccaatttttgtttatctgaacaattggaagtttgaaattcccaataataagataagaaagaaaacagtttaaacatgtttgtatgatataaggttaagagttcagattttgacataatcatctttgagatgtctaacagactcttaagtggagaatttaaataggcagttgggtaaagtatttggaattcagagaaagtagctataaatttggaaatttttaaagcaactagattagatggcattgccaaggatcattctgtgtccgtatgcttgtgggtagagaatagaagtggcaaaccctatttgtggcaaactcttaatgttaagaagtctggaggaagaggaagagtcagaaaaacagcctaaaaagaagtgtccagttaggtaagagaataccaggagaggatattttcttggaaggcaagtgtgaacagtgatcttaagaggaatgaatgtcaaattcttctgaaagtctgggtaacttgaagactgaaaattaaccatagcatcgagcaatttggggccgttggtgatgctaacaaaagaagtttcagtggtgttagggagatggcttctggttctagagccttgttgtcatgctagctaatctgtggataacaagaataatatctagataaaatattttaaatattttaaaagaaaatatttgacgaaactgaataatgaccagaaacaggcaaaaactaaagagcaattaacccttgaaaaatgaaactatttcaaatgaggtgtgtgtgtttgcttgtgtgtgtattgtctcatagtacttctcaatctgaatggggataacagaaagccaaggttttgtttgtttgtttgtttttggagacagagtcacactccattgccggggctggagtgcagtggtgcagtcttggctaactgcagcctccacctcccaagttcaagcaattctgtctcagccttctgagtagctggggttacaggcacctactaccatgcctggctaatttctgtattttcaatagagatggggtttcaccatctcttgatgctggtcttgaattcttgtcttcaagtgatcctcctgccttggcctcccaacgtgctgggattacaggtgtgagccaccatgcctggccagaaagccaaattttaaagccttattttgttagaggactaagttcagagctgacagagtggctggaaaatttaaatgggaagtttacagagggaacggtctctaaaatctgtataaaaactaccaaaatccttgtcttcctattgaaccacccatgtagggaagattccaattttagtaaaaccagcatccagaaagagaaataaatgaaacaaaacaaaacgaaaaacttcagttcctggccactgggggagaaagattttagtttgaatctaactgcctgctaggcaaaatctcaacacctttcagataaaagttactaaatccagagaatctacaatatttctaacacaatttcaaggataaaataaaatttattaggtgtaaagtagctgggaaaagttacttaataaaaatatcagtcagcagaaactctaagatgatcaagatgttgtaagtagtagacaaggcctttttatcaggtattgttaacatcttcaaaaaccaaaggaaaaacataattatagtgaatgaacaggtgggaaatcttacttgagaaagtgtgggaaagaaccaaatggaaattctagaattaaaaacaaatatagagaaaaagcaggcatttcacaaatataaaagagccaatatctgaggaggatacaactataaatatatatatatatgtctaataattatatacctaataacacaacttgaaaatacatgaagaaaaactgacagaactaaaagggagaaatagacaaaaccgtaattggagactttacacatttctcagtaaattatggaacaacttgacaaaatgtcaataataatgttgaagacatgaatggttttatctaccacatttatcatattaacatttatagaacatgacaactgcagaattgacagtcttttaaagcatatatggaattttatagagatagaatgtatgctagaatattaagaaatctcaataaaaattcatgttccttgtccataatgaaattaaataagaaatcaaggtaatcatagaagaagtataaggcagtgctttgaggggacaatttgctgttatgatgcagctggaggtgaagtgggatcagtagatttaattttttttttttttttttgagacagagtcttgctctgtcacccaggctggagtgcagtggtgcgatcttggctcactgcaacctccacctcccgggttcaagtgattctcctgcctcagcctcttgagtagctgggattataggcgcccgccaccatgtctggctaatttttatatttttagtagagatggggtttcactatgttaaccaggatggtctcgatctcctgacttcgtgatctgcccgcctcggcctcccaaagtgctgggattacaggtgtgaaccacttcgtccggcccagaattttttatgttgatggacataactgattggtgagagtaaacttggtgtaagaaagaggagacttggaggtctctgagtgggcatgggtacaggagcagacatagtttacttacagtaacatgagaaggaaggcagtttacatgtgtaaagatactggaagatagatagcatggcgagaattcgtatgaattcacattttatgtctgccagataagtgatccaaccagatttgtggttttagaaggccattgtaattatagtttggagcaattattttgtgggcaagattgcaggtagccatactattaggagatggctataagccaagtaagacatgatgatggcaagaaatagttaatagtgtgtaaacaactctgacatttgaaagacatttggaatgtggaggcagcaggacttttttttgttgtttgtttgtttttgagacagagtctcactctgttgcccaggctggagtgcagtggcgcgatttcggctcactgcaagctctgcctcccgggttcacgccgttctcttgcctcggtgtcctgagcagctgggactacaggcacctgccaaaacgcccggctaatttttttgtatttttagtagagacggggtttcactgtattagccaggatggtctcaatctcctgacttcgtgatccgcccgcctcagcttcccaaagtgctggggttacaggtgtgagccacagcgctcggccacaggacttgttaaatgataaaagagacaatatagggagagagggattcagaggaactgaagaaaattcccaggagtttgattcaggcaatttgttttaaggtggtagcgtttactaagatagaatgcttaagaaagagcaaagttgaaaagaagatgatgagtttagtcttagaaatgattggtaaatagatttaaagtttcaccaaaggatctgtgctgaaggtagcatttgccaaatatcagcatacagatggtaactgccaccagctatgtggttgttgagatctccaagaagaggtatggtgagtaggatgggaaagaaatggaaaaaagaagggaatggaaggtctacaaaaagccttgatttattaaataattattctgggccatgcactctttaataagttgtttttacatcttaatatatttcatcctcacaaaaatgctatgagacatgtatgcttattccattttacaagtcactaaatagagaaagatgattgtattagtcttttctcatggtgctaataaagacatacctaggacttggtaatttataaggaaagaggtttaattgactcacagttctgcagggctagagaggcctcagaaaacttacagtcacggcagaaggggaagcaaatatgtccttcttcacatggcagcagcaaggaaaagtgcagcgtgaagttggggaaaagccccttacaaaaccagcagatcttgtgagaactcactcactatcatgagaatagcatggaggtaaccatcccatgattcagttacttcccactgggtcccacccacgacacatggggattatgggaattacagttcaaaatgagttttgggtggggacacagccaaaccatagcaatgatctttaaaaatgtagacaaaatggatctgaaagtaaaaggaacattacaagagtatgatgaccctgaagtcacagacagtttgaagaaggagaccaggtcctctgctgagagtaagaggaaattgctgtgatacaagagtcaagggaaatgagaatttaaatgtgcagtttaattgctgtgggtgctagaagatgagacagattgatgagacatactataggccctgtttattatagagaccatgatggtcatggtcagccatgattgatgttttgctaagcatgtaaccaaatgaaaaagacacagtgggaatatggactttggcaaagaatcggatgaggtaataaactatgttgaaaggtaaaaacagaaaaagctaataagaatataaaaatgttgtcatggactggaggtcctagcaagtttaaaaggcaagtttaatggcagttgctgaacaaaagagtcaagatatttggaagttgctatctgaagcagggtctttgcatttaatattttaaaactggagcacttctgaatgatggcaaattccaagaatggctgtgagaataaatagaagtaaaagcaacaggaaatgaggatgtcaaagacatgcatagatagtctactgaattacttgcttccagggatcagaaatgccagattctggcaggacttggtatggagacaaaactgggaggaggagacaaatattcagtgattgaggtggaggcagaataagttggttgatgagaccaatgaggtggaataaagatctgtgccccatttccaaagaaaagaggcttttatgggagagtaaaggactgatggtctaaaagagctagtgtggagagtactaagcccacctcctcaccttggtatctggtccatagtaagaactgaagaaaacagaactattgtttcagtcttgccttttctttgtatatatttatatgacttttcatttatctttttataaatataaacactattatgtgccatagagtgaagcagaattttctcccaagggaactaatatgtgcttgatttacaaaatagaaatcattatgaattgtatgccttactaaataattctgtaattatatgttatgaaacaacttaaaggtgtgatgcaaaggaaagaattgtcatccaataaatggagtttaataatttttatttcacggtatgaaattttatatagttttttatgttagaggtacagcaggtgaaagtaggttttatttgattttaaggatctaaacggttttaattatacaacagaatgtctcagaaaacatgaccattttcaaatacttttgatgaggagatgggttttttttaatttaaaggcaaatacacagggttttggctatatcaaaattgtgaaataccagttagcttaggataactttatcatctttgaaaatgatgaaagtaattaatacacttctttttaaaaccacatgtaatttttgagaatagatgactatttcaaatagtcatgtgaaacttctcttaaaattaaaatagatattagtgaaagagtcataaatgcaggctttcactttattggacacaaaatatagaagacatggaaatgtgttgggataatggtatgatcttagggtaggtaggaatgctataaatatgaaattatcccatatctttgtccaagctttgtggcactttcttccatatcctggatgtcatactttttcaccagggtcttcacagctttttcagcccttgataaacccttctgtttgaaagcaggtggttgcccctctgtcacctggaaaagacgtgggctttctcagtctgaagatggtattcactgggaaaaaagcatggcctcccacctgacaaagagtatagctgctgtgccttcattctacagattatatatttaggctaagccttttttttttggattggatcttggacattatagattaagtttcttggacttattttagttgtcagttctaactctaatgatgctcaggcccagtttgcttcccttttttcctgatcctgagaggaggtctcggtatcttcacagctgagcagtcattgtcagtgcacattttgtgatttttgtcatttggggattttctttgccacatagttacagaatttgatttagcaattgggaccacaggcaaaccatatctttgataacgctgacccttgacaagtcatcatcctacaaaataaattacagggaaaacagttcttattccagtgttcccttatcaaactctacatcagagttagctgtgagtgatttctacttttagtattggagatgaatattagatattttctttttctttctttcctttcttttcttcttttttcttcctttccattcctttccattcctttcctttccttttctttttcttttcttttcttttctttcttttctttctttggcagagtcttactctgttgcccaggcaggagcacattggcatcatctcatctcactgaaacctctccctcctgggttcaagcaattctcatgtctcagccaccggaatagctggttacaggcacctgccaccatgcccagctaatttttgtatttttgtagagctggggtttcaccaagcaggacaggctggtctagaactcctgacttcaagtgatccacctgcctcagcctcctcaagtgtgggaattacaggcatgagccactgcactcagacaatattcgatgtttctatagataattcagttactttataatcaaataatgattattaatttttctgatattctagagccatcttgaacttttcactattttaattaaacttctgtatccatgtgcttctctacccttttttggttccctccttcctatctttgagcttccatgataagaatacaaaccacacttaactatgttttccccaacctcactggatgttctcctggttttcattgttggcttttatcctaaacacatacttttaatgtagatgttctccactactccatcctgggctgcttctgtttatttatttatttattttttattttgagaccaggtttctctctgtcacccaggctggagtgcagtggtgtgatctcggcttactgcaacctccacctcccaagttcaagcagttctctgcctcaacctcccgagtagctgggattacaggcacccaccaccgtgcccggctaattttttgtatttttagtagagatggggcttcaccatcttggccaggttgatcttgaactcctgaccttgtgatccacctgcctcggcctcccaaagtgccgggattacagacgtgagccaccgcacccggcctgtttttatgtttttatatacttttcactgatgtcttaaaagtagcatgtccagaactaaactcttggttttattcccaaaatctagattgtgcttgtgcttagagagtaaatctcttaacacctgcctacaagaaggcatataatgtctctgctgccacctctcctgtttccttccaactttccacttgctccgtaggttctagtaacgttaacctttgttcatttcttgaacattaggaagcacattaatacttcaggacactgtccatcctgaactctttgctcaccatgctctttctttaggtctcatcttaaataagacgtcctcagagagcctattccagctactcatctacatttatcaactcacacacccattagtctctatttcaacatcctttgtttcttaacagtactaatgactctagtttgcaattattttgttttatctatgagaatatgtttcagaaaggtagaatcacattgctctagtatatccttgtatccctattacctaatttagtgcctggtgaatatacaataaatatttgagtgactgcatcttaagaatttcttttgttaaaatcactcccttttagttgtctatgtatgctgtggcattagcttcagtgaagtatctgaccaatggcactagtctagacttagaactgatctcctgggaaggcccaaaactctgcctggcaacagcatatttcaacctatacccagcagcatacccatagggcctgatcagtttgaattcccttaaagtctacctgttatcaattcattttaaactgcatgtgtatctatctcttcaaatagtatgcttacctatccctctatttgtttgtttcatttagaaatgaaatacaatcataatctttatagtattatatagtactcataaataattagtttcctaattggcagagggattctccttctctccattaatgacatgatagttttgaaaatagatagttcctgacagctgtatatcaagagtttatttgtgggtagagtgacattacactcatatttcccataaaagttatataatatatgtggttattaggcttctcatctagtcctcaagctagttcttaaagcctattgaatattcttaaagtgaaatcgtaatactacaatttcaaacaatatattatttataatgttataatgtttggtattctataaaaaatagggatctgaagtcaaatttggatgtacaatatattacattcattccagcagtcagtagttctcaggcaggtatataacagaatcattcatggagcttttaaagtatacaagttactaggtccaatgtgggagattataaattagtgaatctgcattgtgacatgatatttatgcattgtttaaaagcttcacaggtgactctaatacacatctcttaagaaccaacattcagggaatttgctcttgaaattttccaaatccatgaattaaaagaaggtgtgttggaggaaggggttttaaggcttttcactatgtgaatgtcaaggaagtcctaatttgggaaatgcgataattttattttcctatcttactttacatatctggaattttcaggttacttaccttttctttacctggaatctagacctatagtcatgataataatggctttcttgtttgtaggggaatgctttataactcacctcggtttataatgaaatattcttcttgtatttcagttcctttaatctcttggtctatattatggccaaacaactctcatggcctctactagaacaaaatgtagtccttcgtgaataacaaaaatagcatttggtaaaagttatttatacagctgataaaatgttattctaatttgcccttgactttgttctgcttatatactattatttttaactgactgagaaagttaatatattcagtttatccaaatacataatcagaactagatttaattgcaggaaaatttggaatataggaaaatatcaaagaggttaagatgaattttatgacatctcaccaccgggaaataattttatattgtttcttattgagggaaaaaaataaaggctgagattaaaccctaagtgtatccagccggtagggggcagttcttctaattcataggactattttgtctttaaatttagcactcggagggtccctttccttgacctttgacatcagtatttatgcaccagatggataatatttttgtgtgaggcagctttggcaccctttggctaagatacggaaataatatatatttattaatacctgatggcataaaaatagttaccataattcaactcatctaactattatcattatatagacctctgttagtaacctgaactacttggaaaatttaaaagtcagggtttgtttctttctttctttctttcttttttttttttttttgaggcagagtctcactctgtcgcccaggctggagtaaaatggcttgatcttggctcactgcaagctccgcctcctgggttcacgccattctcctgcctcagcctcccgagtagctgggactacaggcgcccgccaccacacccggctaattttttgtatttttagtagagacagggtctcaccgtgttagccaggatggtcttgatctcctgaccttgtgatctgcctgcctcagcctcccaaagtgctgggattacaagtgtgagccaccgtgcccagccaagtcagagttttttgtacacagaatcctgagctacataggcttgaagataattcgtactggaaatgaacaaaaatatcactgtcctgcaatttgtttatagtttgcctcttccccaggccttctttttcctgatattccaattttgcttctttcagacatctgagaaaacagctaaaccatttgccactgccagtgagtctgtgcatattcttatcttggctacttttcttcccacacacagtgaatgaatgacctgatggactgaagctcagcccatcgggaggattatccctcacagttgtcctcaggggcaccctgagtgaggctatgatgcagaaacagtgctttcaaaaggtgtatcatttctgctacaaatggcatgcacttgctttataatgctagggttcctccctttaagtgtcctattggggcctgcaaagattccacactgaattatacataagtgacctctacacattgaatctgctgctgtgtggcctaagcatattggcagcctgggcctgctaccataccctttcttgctctggaccccacccaaaaatgaccttctgcatcacctaatgaatgggtcagagcaataatacacgctgcctccaacatccgaagaggcctacaagatgttgagattctttctttgtgatgggtggcacgggtgtaatagcttgtcgtttacattggaggagttgtctcagcaagccccaggccagtgaacctctgaaaactttatgcatatagcaaatatcccctgccctccggagcatgttgctgaccaagggcatcccgagtacatgccacttctgttcatcaagcataatttacaaaatatcatcaacataatggacttatttgatgttctttggagtattcagttccttttagactatcttgtgatagaaggttaaactaagccctggggcaaatcaacaaatgtatttattatccaccacatgtgaatgtaaactgtttttaattccccttcctaatggatatggaaaaggatgcatttgtcagatcaatagcttcatgtaacataccagagattatgggaatgcattctagtaaagataccacatctggtatgtcatctgcattacagctaccatgttttcagtggcccattttcacttgccatgacctatctgtattttatatatttttttgcaggtgacagactggtaaaataaattgagatataatgagagctatcacttctgcacctcagaggctaaaactaatctctgcaattaaccctaggatgttatattttttgatttactaacgtggtctgtttcagggacttgcacttggcttttcctgtaacaataacctttataccactggacaaagaatcagtgtgagggttctgacagctgttaagtatgtccatcccatctgtacattcagggactggggaaatgacaaccaagtaggcccatgtacccagcagaaaattttaaaaaacttagaactgagaaaaacctaatggaaaaccgtggccagcactctggttattatctgatctcataatgtcgttatctgctcaaatcctgtatcctatccacaacctttaaaatatgtaggtattccccttttctcagtgtgtacttaccttgttgcacagcctctttggagatggacttggggagtcacttctgtatgtacctgccagggaattgcagttattcctcaaatagatctgacctctctcagttgatgcagccttggtttgagaactggctcagggttgagaactgggaaagggattgactttccattgaggaagctggtcagccttttgtttatttattcgtgatctctttgggttatatagtaagtagtactctcgttcagtgctcatgtatcctttctctaggaacaccatagtctatgagcatttccatggatccctgtgggttaggacacccccctcccgccccctgcatcctgccattaagactttgcacttgttacagtaattactcccaccttgctgctgacaattaagtactgttacatgtctctgatatttggggaagccattatctccattactaccagggagctcagttctgcaactttatctcctacctacagagcacgtacaactacagagttttcaaaaatgttggtacctccgtcaccaagacctcccttattgtttccgtaaacagattgtaaacagattgtctcctggacacttctgcagaactgagtcaggtggagggtctttcagtctcctataatgggttgactctagcatgtccacttctctgtgcttttgattcttccatcatctgcctgctcactcttgaatctctcccatatttaatgtgggccattgtcttctctgagcttcttatggagcattgtttttagtgcatctctaagcatcattgccagggcgttcaattttgagtcatgggatagtgccctgtttttgccaacctttcatctatccagttcccctatctaataaggccttgattttgtcatgtgagcattgtctaagctgtgaatcctgccttctctaatgttctgtaactttcacaattaagtcctagtcttggtgttcagcttgattagcccttcaagtgtggtagatgagggtttctctaaaccctgacagagaagccctcagatttccacactttgcttcatatggttgattagtgattggagcctgttgtttctctctctaaagcaaaagttgctctcaggaatagtcactcaattgcacactaattttgcagttcctattttttccccttatctttcaaacaccaatgataacacatacactggtgcatctgtaacctatatcttgtatcatccatcacaggtgaacatttcagcaattgtcctgcttcatcatgccagggactatcagatgacactttgtccagtggtggggactttattgcatctggctactgagaaattcagttttagaatcccatccttaaagagtctacttcctaaggtactcctggcactagctgtcttatgtcaggtttcctagcaggggggcttgatgaagggattcctttgtgaggcagggttctcagaaaacaacctgtaaagaagtaagggaagatcaggatgggggaagaagctaggacatgatatggtctcaagagaagtacagttcaacctgatcccatagggagctctgaagtataaattgcatcatagagactgtcctctccagaagcaaaagatctgggcatcggtcagtcatcagccaagggcagcccacaggcagagggtggatgcaggatcacctgggcatccctgggcaagaggctaatgccagtcaagggcaattcttcagagaagagttccagtgtgagccatgggcagtaggtaggggatgcataagcagccattaagagggattggatggggacacctatagcatctgctacacgtcacctcatgttagaatactgaaaaataaattactattagtaggtcagcttttggagttttacagacctgcattcatttgggcaagataattaacctttctgactgtttcctctacagtaaaacaggaataataactcagcttaaatttgaaagggtttaagcgaggatgaatttgtgaagtctccagtagagtacttgctttataatgggtgctaaattaatgttattatgttgacaaagaaagtagaacttggctatttaccaagaaaataatatgtatgtttatctaattctatttaacacagaaagctaattgatatcttttacttacctcaaaaagaaatgatgggccgggcacggtgactcacgcctgtaatcccagcactttgggaggcccaggcgggcggatcatgaggtcaggagatctagaccatcctggctaacacggtgagaccccgtctctactaaaaatacaaaaaattagccaggtgtggtggcaggcgcctgtagtcccagctactcgggaggctgaggcaggagaatggcgtgaacctgggaggtggagcttgcagtgagccgagatcgcgccactgtacttcaacatgggagacagtgagactctgtctcaaaaaaaaaaagaaaagaaagaaatagaaatgatggcactatgcctcttagttcatttgcaaaataaattaatgtcataataatgctgtattaatctcacatgtaagaataaaagtataatatttaaaatgaggtattatatatgcattaatcaatatgattaatattcagagaaagtgagctactattagaatttcctttcaacatactactcagtaatttttgaaaaggttattgatgaaatgatacatgtgcattaaatgaaattgctcacacacaaataaatatctctatacattcagatatatattggcacaattggcccagcatttgctgaacataagtgattcagtaaattacattagagtatacaatgattgcttcttgactatttttctcttcttttgttgtcatttcatctcctgaagattgactaatttttttgtttttttgagatggagtctcactctgttgcccaggctagagtgcagtggcttgatcttgtctcactacaacctccgcctcccaggttccagtgattctcctgcctcagctttccaggtagctgggtttacaggcacatgccaccacactcggctaatttttgtatttttagtagagatggggtttcaccatgttggcctggctggtcttgaactcctgacctcaggtgaccgcccagtgtggcctcccaaattgctgggattacaggcatgacccattgctcccagctgccaatgattgacatttgtctgttgattcttatttatctaattccttttggtagatgaacctttgcaagtaccgtgtctgctgttcttgggtttcttcatttaattctgagggcgtttgcatttagggaatgacactgatttacttaattgctttggtataccctttataactactacttgtgtctctttgacacaagaacacacatgttcacgttcatcaggggcatgattcctattgttaactacttccctttaggaggttgtcttctaggtaagcatatttcttttatgcttatcaaatatgaaataaatatacaaccaactcaatagaatgtcataggctaatatggtaccacagaatgaagcaattataaagttaagctgcataatgaggttacttttggagaatattggaccttaatggcaatttaatcaacttaacctgctttaccagagatgatatgcaacagctaatatattgagccatcaatagatggagatagaaactgaatctgtaaacatttgctttgcaaaaccacattcatctcaggcaaataaccttttttcacttaaacaattactttagacaatagcaacaatttaaaaactgagatacatgcagtacttatcacaataaaatcagtatctctatttttaaaaccatttcgaacagtaatgtgaattttttgggaatatatgtctaagcttgtctccatttgttgtgtagattaaggtatttaccatattttatgttaatattaatcattttacaatcattttcattatgtttgtcctataattacataaataagaatgaaaatgggcagattttcaagttgctcactatttctatttttcatccaaaagaatagtgcaatgaggagtccatacctgatagacatgtggaaatatagctggacacatttatggagtggcagtcaatgacaaggcacaaatacatagtgttatgacatgggaaatagttcttaaggttgaagttcccactagagagcttgtggtgtagacacttagaattgagagcctaaaaaagatggtatgataagagcaggtttcacctactgagtactatcttttctcatgttttctgtacctcgtatctctcgtatctctaaaaggtcaaagatactgcataagccctctggaagctacctcttcccaagtctccatattcacactgcttttgattaatcgatccgtttaccttctcactgtgcatcgggccttctgtcattgtttccctttatatccagctcatcattacaaataccttcaatgccagtacaatccttagatcatcctaacctatgaaactcaaactctgagtgaatccactatctcttcccttggaacactctcttcacttgcttctgtgcattttcctaactcactggccatttttaaaattttagcctcttttgatgactttgttttttctctattaaacctacaaattttgtcctggtctccttctcttctttgtctgtctgtctatattcctttgctattttattctattctcatgtcttttttttttttttttttttttttgagacagagtcttgcttcgtcacctaggctggagtacaagggcataaacatgactcactacagcctcaagatcctgggctcaagtgatcctctcagctcatgctcttgactagctgggactacaggcatgcaccaccacacctggctaatttttgtggtttttaaagtctttttggtagagatggagtctcactgtgttgcccaggctggtcttgaactcctgggctcaagtgattctcctgcctcagcctcccatagtgttgggattacaggcataagccactgcacctggtgctcatgtcttatataatctttttttaagttaccagagttatgtatttaattgctttttattgtcacgttgatttggatatctcacatatttcagaattaacaggttcaatttcatcctctgtcagtcaaatctgtgttcctcatctcctccccacctagtcctccaatttcagtaaatgacattaatctgaaggcttgaaatataaaacagaggatgatatttgagatttacttttcttcatgtctaagctggttaggcctgaggtcaactgcaatgtgccaggagagttctatattaacactactcaaaataacaacctttcaacatctcccacctcagaacaatacacacacactcccctttacctcttcagggcccctattttcttaacagttcttattaagtctattattatatttcttatttacttactctttctgtttttcttaccagaacttttgagggcagacaatctgtcttttggctatttgtcttcatcccctaccacggtgtatggcacataaacatcacgaaataaatagctttgaatggcgaattaaccatcttatatctacttgaacatcatttataagaaccactggggccaggtgtggtggctcacgcctgtaatctcagcactttgggaggccaaggcgggtggatcacgaagtcaggagttcgagaccagcctggccaacatggtgaaacctcatctctactaaaaaaatgcaaaaattagctggatgtggtagcaggtgcctataatcccagctactcaggaggctgagggacgagaattgcttaaacccaggaggcagaggttgcagtgagccgagaccgtgccactgcactccagcctgagcaacagagcaagattccgtctcaaaaaaaaaaaaaaaaagaactgagaacacatcagatatggataatgaacctaggatagttggacatgatgagagacacttactagttattgactacaaaagagtagccaagagaaactgagagcagcctcactctagggacatcttatttccaaaaagacaagcatgactgatcagtttcctctttttatttactgctggtctttcattatatgcttcacaaagtacagggaagaacaatgttttactggcagagttagaaatcaagataaggagtgagaactaagataaattgcaaagactcaactattagtgtagaccttggacagctagctaaaagaatacagcctggtgaattggagacaaaaggtactccaaatatttggctaaaattttgcaaatatatttgggttacttaattcatttgaagtgtttaagtcaaattataaatcacattctatttatttaaaaatatttattgaggacctaccatgtaataagaacttaggatatatcatcaatgaacaaaacaaacttttctgccctagtggtatttatattctggggtaaagacaataataaaccataaaatatgttagaatatgttaagcataatttaaaaaatagagcagtatggctgggcacggtgcctcacacctgtaatctcagcactttgggaggccgaggcgggcggatcatgaggtcaggagattgagaccagcctggccaacatggtgaaaccccatctctactaaaaatacaaaaaattagccaggcgtggtggcatgcacctgtagacccagttactcaggaggctgaggcaggagaattgcttgaactcaggaggcggaggttgcagtgagccaagattgcacaactgccctccagcctgggcgacagagcgagactctgtctcaaaaaaaaaaaaaaaaaaaaaaaatagagcggtacaacggtatatgagaataccgctggtattgtaggtggaggtgcatggttcatgtatgtaaataggagggtcagggtgaatttcactgagaaaatattatttgagaaaatttgaaggagtgaactgtgctgataactgagaaattaatccacctggcagaaggcacaatcagtagagaaattcaaaggcaagagcaggtttagtcagtttctagcgagagcaaagaggttagtaggtagctggaatacagtgaacaggacatgggatcatagagataaggtataagtaccttgtttttttgtgctgagtgaaggtaccttggcatgatttgggatcaaatgaacgttcgttatatattctcctcttagtggttccactggctaatattggaaagatctcttgtcacttttgccttcacatttacactttataatttaacacacctgggaaaggcacaattatatgcttcattagtttcctgacctaatatttggcagaaggccctacatatttttctttatactttattttcatcgaaattctttgaaactttattcagagaagtaggtaaaagcctcaggcataggcttacacagtttcatttttatcttttacatctaaactcacacaattatccataagctctatcatttatgcactttcatttaacaaacatgtattcagcacctactgtatgccaagtactgtcaaatgtatatgtgagaacacaggccttttttggttccatatgaattttaagatttttttttctaattttatgaaaaatgacagcggtattttgatagagattgaatcaaatctgtagatttctttgagaaatatggtcatattaattctgatccatgaccatcggatgtttttctgtttctttgtgtcaccttcaatttctttcatcacttttctgtagtttttcttgtagataccttttacttcttgggttaaattaattcttagggttttttttttggtagttattgtaagtgggatagcttgcttgattttttcttgtctagataattattggtgtgtagaaatggtactgatttttgtacattgattttgtatactgcaactttactcacttcacttatcaaacctaggagtctttttggtggagtctttggatttttgtagatataaggtcatatcatcagcaaagtgggacaatttgatgtcctcttctccaaattgcatgccttttatttttttctcttgcctgattgctcttgctaggactcccagaattacgtcgaataggagtggtgaaggtggacattgttgtcttgttccagtccttagaggaaataatttcagtccttttccattaaatatgatgttagctatagatttgtcatatatgacctttattatttcaaggtatgttccttctatgtctagtttgttgagagtttttatagtgaagggatgttgaaatttttcaaatgctttttctttatctattgagatcatcatatggtttttgtccattttgttgatgtgatatatcatatttatttatttgcatatgttgaactatccttgcatccctggcataaataccacctgattatggtgtgttatctttttgatgtactgttagtggtttgctggtattttgttgagaatctttgtgtttaagttcatcaggaatattggcccatagttttcttttttgttgttgtgttctcatctgaatttggtatcaggataatgctggcctcataaaatgagttagggaaaattacctcctttttgataattttaaaatagtttcaggagaattagtattagttctttgtatatttgttagaatttgtctgtgattccatctggttctgggcttttcttttttgagagactgttactgattcaatcttgctactcgttattggtctgttcaggttttctattacttcctgattcaatcgtggtaggctgtgtgtttcaaggaatctatccatttcctcaaggttttccattttgtcagtgtatagttgttcatgacagtctctgatgatcttttgtatttctgtggtatcagttgaaatgcctcctttttcctttctgatattgtttatttgcatcttctctcttctctcttggttagtctagctagtgttaatgtacatcttgttgaagaaataactttttattttcttgagtattgatttgtagtctattttgttcagttttgctctgatttctgttatttctttccttctgctaattttgggtttggtttgttcttgcttttctagttccttgtggtacagtgttagattgttcgtttgccccaatctttttgcttttttgatacaggtatttattgctataaacttccctgttagcactgtttttgctgtatctcacaggttttgttatgctgttttcattttcatttgtttaaagtaatttcttatgttgaataacatttaatggttattttattaggaatttatctgtctatgttaatgagagctattagtctctatttttgtttttgttttgtagatattttgtcaggttttagcatcagatttgtgctgggcacatacatcagttggcaagtgtttcctctaattttctgaaagcacttgttataagatttgtgttaattgtttcccttaaatgttgataatattttactatctgggcatgtactttcattgtggggaggtttttatattaaattcagtttgattaatacatacagagttattcagattttttatttaatctagtttcaagttttattttctttcagatattatagtaatttaaccagttgtaaaaggccctacagttaaaagaccaaacttgaaaggctaaatattaaaaacacaaactacaagttatttccatgaaatcagtcaaatcatgaaataaattttgtgcaaatactaaggaaatatatacatctatataaatattagaaaaaataaaattagactacaaaattgtattaggaaataagagtgtatttagcactcttaaataaaaatgtatttattaaaattatttttattgacaggtcataattttatacatttatgaggtacaatgtgatgttttgatatatatatgcaatgtaggataattaattcaagccaattgacatattagtcaacttgcaaacctatcattttttatggggaaattaaacttgtaatttactcttctagttattttgaaatatacattattattgactattgtcaccctgctatgcagtatatcacaaaccccccattcatctaaagctttgtaccctttgatcagcaattacccatttgttccctccctgtactcccaatcagctcttggtaactaccattctattctctacttctatgagttcaactttcttagatttcacatataagtaagacaatgtggtatctgtctttctgtgcctgtcatatttcatttataataatgtcttccagattaattcaaatgttgtcacaaataacaggggacccccaccctttttaaggctgtatagtattgtgtgtgtgtatatatatatacacacacatatgacatataatttattgtcatatatatatatatgacagatactttatcctttcatctgctgatgaacacttaggttgttcctatatcttggctgttgtgaatcattttgcagtgaacatgggaatgctggtatctctttaatgtattgattttggttcctttgggtgtatactcagaagtagaattactgggtcatatggtagttctatttttagttttttgaggaacctccataccatttttcataacatttcttttaatttacattcccaccaacagtgttcaagagttcccttttctctgtattctcaccaaaccttatctttcatctttttgataaaagccattctaaaggcgtgagataatatctcgtttttaatttgcatttttctatagtgatgctgaacattttttcatgcatctggtggaaatttgtatgtcttctttgagaaatttctgctcaggaactttgcccattttaaaattggctttattggtattgagttgagtttattacatactttggatattaacttaccaggtgtatggtttataaatattttctctaattctgtggattgcctcttcagtctgttaattatttttattttgtgcagatctttttagtttgatgccatcactttcgtctatttgtgctttcattgcctgtgttttaggagtcgtagccaaaaaaactgttgcccagaccaatgtcatttagcattccaggccaatgtcatttagcattccccctattttattcgagtagttttacaatttcaggacctatatttaagtcattaatccattttgagttgacttttatataaggggtgagataaaggtccaatttcattcctttgcatgtggatattcagctttcccaagagcataatctgaagacagtgtttttccccattttgtactctcagcacctttgttgaaaatcagttaaccatagatgtatgggcttgtttctaggctcactgtcctatttgactgatgatgtagctgtgttatgctgttttgattactatagctttgtaatttgttttcaaatctagtaatgtgatgcttccagctttgttcttttgggtcaagattgctttgacttcaggaccttttgtgattccatacaaactttaggattgtattttctatttctttgaagaaatgcattggaattttgacagagaatgcattgaatttataaatcactttgggcagtatgaacttgaattacactttagaccaaatatacctaacacacataaagaatattccactcaacagtagcataatataccataatgtactttcttctcaagtgcacacagaacattctccaggcatatatatgttaggtcagaagacaaattttaacaaatttaaaagtatttaaattatatcaagtgtggcaatggtatgaaactagaaatcagtaacaagaaaaatcttggaaaaatacacaaatatgtggaaattaaacacgatgctcctaaacaacctgtaggtcacagaagtaatcaaaaaggaaataaatatcttgagacaaatggaaacataaacataaacataacacatccccaaattatggaatgcagcaaaagcagtcctaataaggacatttatagcatttaatgcttatatcaaaaaagaaagatctcaaataaataatctaatgttaagcctcaggaaactagaaaaagatgaaaaaaccaagtccataattagcaaaaacaagaaaatagtaaaaaccagagcagatctaaatgaaatagagactaggaaacaatagaaaaatcaacaaaatgaagagttggttttttgaaaaggtaaacaatatggacaaattgttagattaagtagggaagaaagatgactcaactaaataaaattagaaatataagagcacacattataactgatattacaggaacaattgtgaacaattaataactaattggataatctagaagaaattgataaatttctagacacatggaccctaccaagactgaaacctgaagaaatagaaaatctgagaacaatgtaaaataagaatgaatcagtaataagaattcttcaattaaaagaaaacatccttgattggatggcttcactgctaaattcactcacacattcaaagaagatctgatgccaattattgaaaatttccaaaaaaatgaaatggagggaatacttctaaattctttttatgaggctggaattacactgacaaaaaagacaaggacactacaagaaaaatatttataggcaattatttctgatgaaataatgcaacttattctcaccttgagttcagtttgagaattgaactcaaacacattacttcaaagactcattttcaagtgcacacagcacattctccagacatatgttaggttgcaagacaaatcttaataaatttaagaagattcaaattatatcaggtgtctctgtgtgtggcaatggtatgaaactagaaatcaataacaagaaaaatcttggaaaatacataaatatgtggaaattaataattaccacaataaagtggtatttgtcattggaatacaaagatggctcaacatatgcagatcagtaaatgtgatacacaacattaataaaatgaaagatgaaaattatatgaccatttaatggacatagaaaaatcatttgacaaaattcaacacccttttatggaaaaagttttcaacagcttagatatagagggagtgtacctcaacccaataaaggccatatatgacaaacttgtaggtagcatcattctcaatggtgagaagttaaaagcttttccttcaatgtcagaaataagataaggatgcccactctcaccacctgtattcattatagtactggaagtcctagccagagcaattaggcaagagaaagaaatacaagcatccgagtagggaagaaagaagtaaaattgtctgtatttgttgatgacatgatcttatatagagaaaaccctaaagatacccctaaagaatttgttacaattaaaattgaattaagtaaagttacaggatacaatattattacacaaaattaatagtgtttgtatatactaataacaaattatctgaaaaggaagttaggcaaacagttccatttacaatagcaacaaaaattaaatacttagttctaaattcagcaaaggaagtaaaagtcctgtacaacaaaaacactgacgaaaaagttaaagaagacacaaataaattgaaagatatcctgtgttcatgatatataaaaattaatattgtgaaaatgtctgtactacccaaagtgatttataaatttgatgcaatctctatcaaaatgccaatatcatttttcacagtaataaaaaaatcaatattaaatttgtatggaaacaccacaaatacccaaaacaatcttgagcaaaaagaacaaagtggaggcatcacacttcctgatttcaaaccatattataaagaacttataatcaaaatagcatggcgcctgcatacaaacaggcatatcggccaataaaacagtatccaaaacccataaatatgcccatgcatttatagtcaaaatatttttgtgtcagttttgatggctacatttttcattaatttgaccattccatctgaatagtcaaattcactacaaaaatgttattcacaaatttcttattttttaaattactgaagttcctctttcctgattattaaaaatttgtgttgtctctcattctttccttttaaaatagcttgttgaggtataataaccaaacaataggctgttcatattaaaagtatatagtttaataagtgttgagatatatgataaatgaacactacaattcaggtaatgaacattcccatcacttcctcatttcctcatatctctttttaatccctccgtcctaactgtcccaataccactcctttttctagacaaagcctaatctcatttctattgctatatagatcagtttccatttcctaaaatttatataaaggaatcatatattattcttttgtttgatttcttttactcagcaaaattattatgagatttatatatgttgctgcatgtatcatttgttccttcctttttatttctgagtaatattctattgtatgaatacatcaccatttgtctatccaacatattgtgggtgggcatttcaattgtttatagtttctggctattacacataaagtgttctgaacattcatgaacaagtctatttaaagacatgtgctttcatttctctggagtaaatacctaggagtggaatagtttctcctatggcaagtgtatgtttaactatttaagaatttgccaaagagctttccaaagtggttgtaccactttacattccagaaggcagtatataaaaactctggtctctccacatccttagtctttttaaatatagccattcttgtgatatccctttgtggtttgaatttgcattttcctagtgataactggtgttgagcatctttcagtgtattcatttcccatctgaaccttttacttgtacaaatctttgtcggttcaaatcttatgtccatttgttttttaaactgttttttaaattactgagttctgataaatttttatatattatggctatatctcctttatcaaatatgtaatttgcaaatattttctcccagtatgacctatatgttcattctctaaatacaatcatttttgaagagtagaagttttaaattttgatgaagtttaacagttttttttatggattgcacatttgcattttatcatagcaatttttgcctaactcaaagacacaaggaatttctccaatgtattattctagaagttttatagttttaggcattccagttaggtttatgatctattttgagttaatttttatatggtgtgagctgtgggttgaagtttattattttgtatatagatatccagtggttccagaactatttattgaaaaactattattttctctactgaattgcctttgcatctttgtagaaaatttgttcataaatgattgagtcaattttgggggtcttgttgtgaagacagggtaatagatgagtgaaacaaatagtgacgcaaactcatctattcccctgtctttacaacaagactacactggcttgcttaccatagctttataataaataagtaatgtttgtcctccaaaattgctcttatttttcaaaatcattttggatattctaggtcctttgaatttccatatgtatgttagaattaggttgtcaactgctagaaatcctgctggtattttgattggaggtgcattcaatttgtagatcaattttgggagaattgaaatattaatactgtggagatttccaacatacgaacacaatatagctctccatttattttaggtcctctctaatttctgtcagcaatgtttttagtttttaatgtttaagtcttgtacatcttttgtcagatttatccctaagtattttataaattttatgctactttaaattgtattaaaaattttcactatctggacgttcattgttacagtatggaaataaaattgatttatgtgtattaatcttgaattctacaaccttaccaaaatcacatattaattccagtggattttttcataggtttctttggattttctccatggacaattatgttgtctgcgaataaagacaattttatttcttctttactgtctctatatcactttttcttgactttatgtcttagctagaacctccacttcaatgtttaacaagagtgatgagaacagacatttgtttcctatatcctgatattaatggaaaagcatacaatcttttatcattaagtatttcagctgtaggtgatacggacaggaggcagataaatactgggtagaagaggatggttccccagcaaaggccccaccttaaatcctggaaacccacagccctaaatgggaacaggcatttatcttttcatgtcccaaagttgccttttggtctgccatgcccgcctatcctgtacccatataaaccccaaacccccggctccacgaggagacaaacagaagagcagaagaatagcagaatggcacgataaagagaagagaaggagtgtctgaatgtcgagaggagtttggctggggatagtcaggggaagataatcttcccactccattacatttccagctccctatccatccctctgagagccacctccaccactcaataaaacccctgcattcatccttcaagtatgtgtgtgacctgattcttcctggaagccgaacaagtacctgggtaccaagaaggcactgagctggttaacacttaagccatcccggatggcaaggctaaaagaggatactgtaagacaggcccacttgggctttgggagttgcagacactcaaccctggatgctgccatagggctggagctcaggggcacacaccttagctccggcacctgccctcctgcatgctccctctcgtgaagggggtttgagcagggcatggtggctgaacagatgagccacacccctgttgcaagttctgtgagggacgtcagggaactcgcctatttcacaggtttttcacagatcccctttatcaagttaaggtagaattcttttcttttgctagtttgttgaaagttttgaactgtgatggataatggatttgacaaataccttttctgtttctatgaagataatcgtatagtctctattctttagtttgttaatttggtgaattacactgattgattttcaaatattaaaccactttgtatccttgggaaaaaccccacctggtcacagtatattgtctttttatatattgttggatttgctttcctaatatggtgttaagaattttgctatgttcagccgggtgcagtggctcatgcctttaatcctagcactttgggaggctgaggtgggtggatcatgaggtcaggaaatccagaccatcctggccaacatggtgaaaccccgtctccacttaaaaaaaaaaaaaaaaattagccgggattggtggcatgcacctgtagtcccagctactcaggaggcttgagcccgggagactgaggttgcagtgagccgagatcgccccactgtactccagcctgagccacagagcaagactctgcctcaaaaaaaaaaaaaaaaaaaaaagaattttgctatcttcagaaggatatgaatctgtaattttcttttttggtaatatctttgtggatggtatcagaatcattctagtttcacagagtgtgttgaaaatattccctccttttcaatgtcctgaaataattttagtaaaattaatactacttcttcctaaaatgttggtagggtttaccagaaagccatctgggccaaaagtcgtctttgtgggaagatctttagctacaagttacatttcatctatatatctatgtgtatctatctacctatttatctctctgttatcaatcattatgcaggttattgatttttttctggattgaattttggtactttgtgtcttttaagaaatcgtcatttttactcagttgtctcatttgttcttgatcaatctgctgagaggtttatttgttggtcttttctaagactcaacttttggttttcttaattttctctttaggttatctgttttctattttattagtttttcctctgatcatttttttcctttttgtttttcaagatgtagctttaggtcattggatttagactttacttttttaatgtaagcatttaaagatatctatttctttctaagcaatgttttagctctatccataatttaggttatgttgttatttttattcagtctcacatatttaaacatttctctctctcttttttgtttttttgacccatggatattttgtgaaagtgttattgtattagtccattctcacactgctgataaagacatacccaagactggggaaatttagaaaagaaagaggtttaattgacctacagattcacgtggctggggaagcctcacaatcatggtggaaggcaaggaggagcaagtcatgtcttaaatggatggcagcaggcagagagagaacttgtgcaggggagctcccccttatataatcatcagatctcatgagagctattcactatcatgagagcagcacagtaaaggcctgcccccatgattcaattacctcccaccagttccctcccacaacacatgggaattcaagatgagatttggtggggacacagccaaaccatatcagtgatttttaaaaattgttaaatatttgatttttatcttagctacattattattcttgatttctcaataatcccattatggttagagcacatattttgtgcaattccagtatttcaaaatatactgagacttattttatggttcaacatacagtgcatcttgatgaattttccatctgctcttgaaaagaatgtgtactctgaaggctttgagtatagtgttgtataattttcagccaagtcatagtggataataatgttattcggcccttctttgtcctttctcattttttctggttgtcttttaaaaattcctgagaggctgggtgtggtggttcacacctctaattctagcactttgggaggccaagataggtgaattaattgagcccaggaggtcaagaccagcttgggcaacatggtgagacaccgtctttacaaaaaatacaacaaaatggctgggtatggtggtaggcacctgtttcccagctactcgggaggctgaggtgggaggattgcttgagcctgggaggcagaggttgcaatgagctgagatcaccttactgcactgtagctcaggccacagaacaagatcctgtctcaaaaaaaaaaaaaaaaattcctgagaaaggataattcaactatccaaatatgattgtaaatttgtctagctctctttttattaattttgtccatttttttgtttatgtattttggggctctgttagatatgtgcatatctatgattttatgtcttgtgaaatcactattttatcattatgaaatgttcttcctttgccttaagttgctatatattattaatataacaactccagccttcttacccggtttacataatatgtatctgtccattcttttccttttaatctatctgcattttaaaatttaaactgtacctcttgcagaatagttatgtcttgcttttccaaatattaaaaaaaatctgcattcctaattggaatccttagttcatttgcattcaatgaaattttcgtgtgcttggatttttgtctaccacttcactacttgttttatatttttactactttttatttctctggtatttgttttctgacttttttgagttaattgcatttttacaaaaatattttactctaatttatctatttgctttaaaattatactactttggaacatttaaaatggttgctccaaggcataaaatacacatttttaacttttcacaccccactgggaaatgtaaaaaccttgcaatcatataggtcattttttctcactccattttggctatcattgtcatatatagtacatctatacatgatatacttgtatatgtcagatttacatgtttttacttttctcattaagcatttaaagctatttccttataaacattgctgtagttgtatctcattatttataatatgctattttttataattcaatataaaacattttgcatctctcttgagagtttctttgattcgtacatctttttgatccatagatttttttgtttttgttttaaaacattggaacacacatacacacaataatttttgttgtaaatagtgatgtgttatcaaattatgaaaaaaaataattgtgtttaaccacctcaactcaacttctgatgctcttattttctctataagacctgagatttcatttggtatcacctctcttcattgaaaaagactttcttcatgatttcttatagtgttagtctgctgaggatgaatattctttgtgctagtttgtttcaagactgactttgtttcccttcattcttgtaggatattttcactggatttataattcttagttctcagttttatgttgtagcactttaaacattgctacagtttcttctggcctctattttttgtttgccttatttttatatgtatgtaatgtgtcttggggcactgcttttaagatttttatgccattttttcaacacctaaaattaattactacataattaatatttgtttccatattataccttgcttcatatgttaaaaaaactaacaatatataatacatataattaatggcactaataacttttaaaatagccataacaacattttagtaagtttgatatctcttgggacattactaattgtgttaacattattactaattgtgataatacctaatgtgtgtctagaaagccttgttaattcatttgactttgagttaataaagtgaatatttctttgtgaaaaagattaaatttataagacagagaaaagaaaaagatttttatgccattttggaagttcagtggtttgactctgacatgcttggacataattttttttatttaccctgtatggggcttgctgagattcttaaaactgtgaattatgtcttccacaaaattttggaagtttctcaccactatttcttatatatcaagatatatatttatgtataatatataatgtaatatatgatatatgtaagatatatatctaatatatatgatatatcttatatatatcatatatagtttcatttatatatatttgcatatatatggaattatatataggttcatttgcatatatatggaaatatatatatcattcaatttgcatatatatatgtgtatatatatacatatatatatacacacacatatatatatatagttccatttcctctctcctctcattttgggactcaaattacatgaaacacatggttttgataaagtcctacaagtcactcaggttctatgaaatcattctcaatcttttttctgctttctctaaattgaacaatatttattgagctctcttcaagcccactgtttttttcttctgtaaatctaattgacttctaatccctaaaggatgtatattttaaaaaatgatcttatactttttagttctataatttttatttgattgatttttatatcttccacttttctgctaagattccttttttttcattaattataagcatgtttttaaatagtttttgacaatggtcatacttgctactttaaaaattcctttctgccagttccagcatctgtgacatcttagtttcaatgtatgttgtcttttctcttgtgtatgagtcattttttctgttcctcacatatctaataactttgacttgtatcctcaacattgtgaagtcactggagtcatttgcctgtgtttctaaaatattaacctttgactcacactctaaactccatctttcctgtagtagcagaaactgaaagctctgattggtgttttagccttagctatgtgtatcagtcagtttgagctgctacaataaattaccataaggtaggtataattatcccccatcatggaaaagtcaaagcatgggccactctcctgggttgttcccttcactcaagttttctcttcccttcgggcccttctgtgggttcatgttcattttctactaggtggggtgcttgcactgattaatagcctgaaatatttgccttcttattgattgttatacaacctcttttaaagtaaaaaaaaaaaaagcatattgcacagagaagtggatttaaaattttttttatgaatgagctatataattatgttgattcaggcaatcaaaactcattggacttcaattctgataattaggaaatgtttgatcttgtatattgagagaatggggaagctatttgttgcgtgtaatttaaccttttgactcatattttccctggaggctctaatggtagagcactcagaagtatttggtttagttcctatctcaaaattgctgtctaataaaacacttcagtttctgctttatacttccattgattggtgttaaaattggcttaggaataccaaacattacagtgtttgaattcgaaacatataatcttgttattggaaaaagcatatttacttttaaatgtgttcataaaacatattggaaaagggctactaactgtgcaatttagtgtgaactgtgtgactaatttgtttaaaatgtaaatgcaaagtatttgaatgtaattattgactgtcaaattgatgattactgattaatattattcatcaatgcacaatagttaacatggataccaaattagttataaaatcaggaagctgtgactttggaaaagggaggagatcagtacagattgatgttttaggaaaaaaacttccagtttcgtaaaatgtcgttagcaacaaaaaagagtatatagtgtacaccaatatatgttctttcagttgctttgtttcttaatataacttttattgttaagttctgcgtttctaatttgacagtattcttcagggaaagaatcaaaaggaaattctaaaagaatttcagaaaacttttttaattgttcagaacttattgtaattgccttttaaaattcagattcacctttgttaattagattaccttttttttttttttttttttttttttgagatggagtctcgctgtgtcacccaggctggagtgcagtggctctgtcttggctaactgcaagctccgcctcctgggttcacaccattttcctgcctcagcctcccgagtagctgggactacaggcgccagtcaccatgccaggctaatatttttgaattttttttttttagtagagatgggtttcactgtgttagccaggatgatctccatctcctgacttcgtgatctgcccgcctcagcctcccaaagtgctgggattacaggcgtgagccaccacgcccagccagattccaattttaatcttgaaaacaaacttaaaaaattctgcgctattgttaacaggaaattttgaggcttatagtgtttattaatgttcacacttagagttaggtcattaaaaatacttactttatactttcctaaaaatgtattttgatgtttattccagtacgtaaattttccatttataatgagaaacacaaaattgagtctgatttctagatcattttggttgttaaaactactcttataccacatgtgaatggaagttacagtaaaaggtacatagtgaatagggcaatcacaaatatagtactgtctattagaacatttgataaagatggtaatgaatatatatatatgagatatataaaatcaaatatactaagagatggaaaagcaaatgtatttaacaaatcaaatatataccactgatgttctataaaatgactacctactgaaaatcttcaaaaataaacctcaaagtaatcttttccttgctttaacaaatttcatgtagatattgctttagcaaatgtcatggtagattaccaaataagtattaaacatgtgttgctagtgtatattttgatgatgctcatctttgcctaataaagcaatacatttaaggggaaaaatgtttgtcatcctagatcaaaggcatctaatatgtataatatatatgctatataaacacatatattctatatataatatctatgcaatatatattacatattatatatcctatatataatataatgcatataatatatatgcaatttaaaatgattagcatcctaaaactatttatgatccagatctgatccaacatatatataatatagtggatataatatatatgcaatttaaaatgattagcatcctaaaactatttatgatccagatctgatccaacctttcagttaaaagttatataatcttacacctcctatttagtactaatgcattgtgtagctccatgttagtgggttaagacaaggaatacatagcaaagcaattaactaacaatcaatcaattaaagtcagtggtatgtatggataaagtttggaagtgcctgtgtggttagttgttcaaaaacctataatagagtataggctgttagcttccaacgtcttgatggcataggttttatccttcacttaaaatccaactttttttgcttggagaagatagaatagttgagaaggtaacaattaatacccaaaaataaaatctgaagaagcaactcaaaagcaatggaagtattcataagggaatacttgattcttactgagctattggttctctgctttccatgtctgtctaggccagtacttattttcatggttaatttacatctcagtgactccatatttttagaagtaatcataatttaattccaaaggcaaaatactaatatgaaatgtggtatgattccttgaataacacatgtaattacttttaacatctcaattaatgtggaagatacaggtagatttttatgggaaatttataggcttagaaagctataattcattttattaatagaatatgtgagcaagaagcatacattttgcttatttattgatttttttacttccttatttttatattatatataaattatatattatatttatattatatataaattatatattatatttatattatatataaattatatattatatttatattatatataaattatatattatatttatattatatataaattatatattatatttatattatatataaattatatattatatttataatatatataaattatatattatatttataatatatataaattatatattatatttataatatatataaattatatattatatttatattatatataaattatatattatatttatattatatataaattatatattatatttatattatatataaattatatattatatttatattatatataaattatatattatatttatattatatataaattatatattatatttatattctatgtaaattatatattatatttatattctatgtaaattatatatatttatattctatgtaaattatatatatttatattctatgtaaattatatatattatatttatattctatgtaaattatatatattatatttatattctatgtaaattatatatatttatattatatgtaaattatatatattatatttttattatatataaattatatatatatttttattctatataaattatatatattatatttttattctatataaattatatatatattatatttatattctatataaattacatattatactgctggagttcagtggctctatcttggctaactgcaagctccgcctcctgggttcacactattctcctgcctcagcctcccgagtagctgggactacaggcgccagccaccatgccaggctaatatttttgaatttttttttttagtagagatgggtttcactgtgttagccaggatgatctccatctcctgacttcgtgatccgcccgcctcagcctcccaaagtgctgggattacaggcgtgagccaccgcggccggccagattccaattttaatcttgaaaacaaacttataacacgttataaacacgttatgttagtgtttccatgggaacacctgagaggagcacctggccaaaaccaaggagtcagggaagatttcctgaaagacgtgccaccttgtctcgttaaatgttaaaggaggagcagtggttattgatttattgatttttttacttccttatttaataagaaatatcaaattaaagcattatagtgaattggaatgggaaagcatatgaacgggaaaagtttgattcaaaacagttataaggatgggatgtagaaggatctctgctccagagagaagctatgaaataataagagggaaaactacttaggacctgtgtgtcttccatgaggtagtggaatgaagaacttttcagagtttctgccataattatggttatgattcttcattttgttcttgaagcccttggggggaaaaaaggagaagcataatctttattatatttcaaatttaacctcattacataaaaccccaaaatatctaattcggattatttcttaaaatgtcaattcttttccctgatagttaccagataggttagttgacccagagaatgaggaaaggcacaaaagtcctgtttttcttggtctctcatcaatccaagaacacagagggataatttttgtcttcctatttgttcagtttttgaatcaacaactttcatttagaactggagttcctactattacactgaatatagtgaaggaggttaccaactgagtgcagtacaatttgagaactttgatgcacaagaattcaggaatgtgggaatccagttgtaatctaagctctctacccagatgcctcattcagtgggcagtggtgaccatttgctgtccttctgctgaattcctgtcaaagatccttgtcagcaaccgaaaagaaacaaggcaaattcatttatgggtaacttctctgtttgcaagcatcacttcttaccatccctgtgttacagataaacttactgcacaaacgcagtggtctttatctgctcctgctgtttagtggaaatagtgttttctcaatctcttctgggttaaccactgctcctcctttaacatttagtgagacaaggtggcacgtctttcaggaaatcttccctgactccttggttttggccaggtgctcctctcgggtgttcccatggaaacactaacataacgtgtttataactatctgtcttggggactgttgtccactgaactataaattgcataaggtcagggaatatgtcttcacttttggatttccatcgtccaggattgatcctgggcaataaaggattcacgataaagccctggtgaatgaatcaacaaatgaatttcaataaatgatgtacttaaaaggcaaattaactatgatatattttaggaggctttattgagtaaaagtgattgagctttcccatgaatgcatcatttgaataacaatttttaaattaacaggttagagaagaggagataatttagcagctattggttggcatagtggcctcttttgtcgtaatttttcattcaaattcttgttcttgttgtgaaaggatgatattgtgaaggtgtacaccctttatttttataatccctgcaattcctttgtttatttcttagttctttattttcaaactaggccttggctttaaagccctgccatggaaaggaaggtgatagcagaaattcaaagtaaaacagaaaaagtcataggttttattactcttattacatcacaaaaatagataataaactctcataggactggttgaagaaaggataacacctaactagagtaggtattgtgaaacaattgtgtctcaggaaggaacctgtttctatttctattacattgagttctaaccacacaaacaaatcttcagacttatttagggatctgagggcagaaagagaacccaggaagccagtgcagtcctcgtttcatatttccctgtgccatgtgatcaaggtttgatagcagaggaatacactgactaattggcatgtatgggcagagagaacttgggaacagccaccttgactgctgctgcctagagtggtgtcagggagcaggtgaggtttttagttgagttggagggcttggcttgaaggtgtctcatggtagatggaagaggcagccataaatgatagcacaaccaagccgaaggaccggaagaaatgggtggaaaaattgatgccagcaaagactaggggtcaaaggcctcctccacaagttgttgatgttgtaagacagcctctcctctgtagacactgaatgtcaaagcttcccctgagaaaagatcaaggaaactgtgcagctttaacttgtacctcaactgactatgatgaacatattgacttgatgctatctacctttatttggaatggaggcttgaattacagaataattttcagagagatcaaaagttacatttgcagttctgacttcttagtgtgacattatcttactcattatattagtttcaccaagatccagttctctaaaatgaaaaggaaaaaaaaattgtaataacttcaagatggggatccatcttctgtgtcccacacagaatagtccattaatgctgacaaacatattttcccatttattgccaacaacatgttatttcaggactttatattgtgtatgttaaatttctgtctctgtctctcttctctctctctctctctctgtctctcatacacacacaccttgtacaatatagctcaccttactgaaataacaaataatgtgaaaatgttatgtattcgatcaaagccacaaaataaattgcagagataggttatagattgaggtctatctcccttcagagattttgtacttctcatttattattgtgacctgaaagaattgatacttcctcaaacataaccttgttacttttttcttactaattgctggcaaatgataaaaccttcagcttgcagatgacttctaaaaaacagtgaatggaaaagagccttgatggcttaagtaatctgttaatagtaaaaagattgatttattataatattgttatttattgaagtcatgagatggcaggagagagtacaatggggtattgaatttttatctagagaaagaaggcattgtgttataaattttttaagttcaattttttaaattacagtactatatcaagattcagttagaagtattaaaaattcaaagattcagccatttcagttgtcaagcatgtagaatcgcaaactttaataagaaaaaaagtttatcaaaagatgaaatggcaagaagccctagagtaggcataactggtgacagtatgtgtggtgtcattaccacattcctctgcaggatgccacacattccagtcccttgtctttccatcattaaataatacatagtgacttttttgggtctcctaaatcttttgttttctttagcgaatattaagttgtaaaaaaagaccataaaaggaacatgtttcctaaagtttttacttctgaacattaataaaatattctgtcaacgttgttaattatttttatttttaaacatgtaaaggttgtgcagttcacacatggtatttactattggattttgtagaatcaatttacttagtagaaatacccttagtttgtaaacaagtcatctaattttcatttagctatataagtaccacataaaaattgattattctcttataaaatcctacggtgacttatttcagcattctatatttccagtgatatgatgtagaaatcaatgctgttgttactaacttaatggaagtataagagttgcatttgatgttgatttctatgttccatgaagaggaagagactgtgtaaacatatatgttcttacactgtcaatatatatgttgacagaatattataaaaggttagttcaattactgtgcagacctatattctaaattatcagcaaatcacagcacacagccaattctcctaactataggcaatgtccgtttaagacagctgtttttccaaccatttttaatattttctgggtttaggaattttccaagtcctcttaagtacagcttatttcagtggttgatttttttttggtctctatgtgtaatattttcaaataacaataactccaaagggtgaagatataaaagatttgtaataatattaagcaaatgaagagcagcagacgtattattaacatgacatataaaatggacaggataaattagaaaaggtcctataggagcactcataaaagttttcatctagccttttgcccaattatattttatattctgaaagaatggaaacaatctctcttaaaattttatagcactcagggcctatactaaatctttcatatgttttcaaattattcatttgcaaaaattaaatttatactgtaattatttctttaaaattgggtagactcaaccagtggcagtggttttaaaaagactccttaactgtgaaacagaattcattgcataaaatacattggaacattcacattcagttattacgacactagtctttcacttgaatgtgtctgtttatgaatttatttgtcaagaaatttttgaaatctatttggtgaaagtagagaagagagaaaaaggataacagatgaggttaccagggaacgttatgaaaagaaggttgtgtttgggagaggtgtgaaaatttggaagagtgattatggcaaataagaaagactgctatttggagatgagtaaaattctgtgaagaaaagtgaggttgggaataatcagtaatgaagtcctttgccacaattttatgtatttttccaaaagcttcaagtaagagcagataaaatgaactgcaggtttttccacagataacctgtgaagggtaggattggggaccgtttggttgaaatatttagttacgagatttaaggtggatatagaattacatgaagacaggcttgttttaacattacaatatataactaaactgtagtgtaattaggctaaatacatttaactcttcataaggttatgagaatgtttagaaataaaacataaaacataaaaattacattaaattggtactaaatcttacatagtgccatatttatctacatatgcaaaagtgtacattgtgtctctctcctacattcataattatacagaattaatcagtttgtgatatcttactttttgcttcaaatcaatcattaattttgaagaactttagattaaaaatgaataggcttctgtagatacactaaaatgtcggattctggtgaacattttcacaatcttggctgtttggccagtttttaacaaacctggagtttttttgttgtgctcgttgttcgtgagattttcgtgtgtctgtgtatgcattcattcaacaaatgttgagtttctgttaggtagcagacataattctagacatcctgaatatagttgtgaacaaaacaaacctagtgtctgttctcaatcttaggatctgattctaaattaggggctctgtaaataattaatcacttacaagtcaaaccgtttaattacttgggtaccttgtttattatagttaatagcttttacttggcctttgcacctggggtcatcctagctccactagaaacaggcaactcaattgaattacagcaggttcacctgcttttgtagctatggtatagctaacctttaattcctaacatcaagtcttcatattcttttctctacagtatgccaagggatgtctgaaaccttaattctttgaagtgggcatgacattggttctaagtttgggctaactaacccaccataccattatgaatgtagtgagcttttcaagccggcagattgtctgctaagggcacctacatcaacacatttagttcactcaagtcccctcaaactcaatatgtacaaatatgctgtagtgtttgttattaaacatgcacagatttccatttatatcagtctgatcaaaataatttacttccatatgtggttattttagacattatttaaagaatgtaaagtaatcctgaaaatgtcaaatgagtattacaataacttcacaaggctattgattctttctgatgaatatacttatttgtcttataaaatttatacttattattaaggaatcagagcatttaaaaaatagatttttaattattgtacaaagcaattaaatatccaaacctgtgttgaatcaggactgtgagtgatcttagtatgtgaaatagtaatgttttctgatggccagaactacatcatctctattgggagttcactgtcttgtttgttacatggagaataaaatcttttatatgtaatttttaaaaaacattattttaagacaaaaccttagttttactttttgcagtgctgcagaataaattctgataaaacaactgttaaagggtccctatgataaaataacactgcgtcctgggtaaattatgacaaatacaaagtttactgcacttcaagaattgctaaaataagttaaatcttaaaggtgcctaaaataaaatgaaatgataaaataaagcagtttgttctgaaggaaagtgcatatttcagtggtgtgatggaaagataaatccatgggagtccagcaatatagagaagctgaatttgaaattcctacgttaagcttggaaccttgaagggacaaaagtgttctccggttgataaaaccttctaaaaccagaaagggcaaatgcaaattcaaattcaagagaaaacatctttcatttggttccaaaccaatctcacagattatattttaaaatgagtttactttaggaaacacaattactaagcatggcagagaataagtcaccatggttgatatatagggaaacaacaatagacttatttcccccaatgacttcagatattggaatgatcaaatttaagatataaattactttgaaacatataaagggataaaaataaaatggaactgatataattacaggaaacaatcaataatgtcttggtaggtttaaaaactatcccaatagaaattttagatgcaaaaaaatgtaattgtagaatcccagcacttcgggaggccgaggcaggtggatcacctgaggtcaggagttcaagaccagtgtgaccaacatggagaaacaccatctctactaaaaatacaaaattagacaggcatgatggcatgcacctgtaatcccagctacttgggaggctgaggaaggagaatggcttgaatccaggaggcagagcttgcagtgagccaaattgcgccattgcactccagcctgggcaaggagagcgaaactatgcctcaaaaaaaaaaaaaaaaaaatacttgagtgaaaaagatagataaagtttagtagagagataggaaaatggatgatagagttttgggagctaaccagaatgtaatacaaaacataaaaggaagtagaatataaaagagtggttaagaaatatgtatgctaaaaggaacagtaacaaatatctaactggagttctagaggacagaataaagaaaatggcagaatgacaatatttgcaaatataatgggtgatgatattccagaagtaacaaaaaatttatagcatatgctattaaggtgtcaaaagaaatttttatttaggtgctttttagtaagtttgaagaacaaagacagaatgaaaattgtcaaagcagccagtgagaaaatacacatcaattacaacagaatgacaaatagattgggagtggatagcttaagagtaaaatgaaaactaaagaacaatagattaataatctttcaaatatgaagaaaaattaatgtcaactttagaatttgtacctgtcaaaaatatctttcatggatgaaggcaaaataaatatctttttagatatgcaacatttaacacatgttaaccaaagaaacttttaaaatacgtattttggaaagaaatgaaataaccccagatcccaggtttgagatacaaaataaaaatcataggcaaataatctagataacataatgtaaataaaatactgtttgtataaagtaataatgataagtatgagaacaattatttttaattaaatacaaaaggaaagagaataatgaaaaaccatagcatataagatgggattgattagatttcaagtgttggaaaatccttttactatttgtgagagggtttataatccttcttgactttaaatgtgttaaaccaaaatattaacatatctgcaacaagaaagaacagaacactatagagaagggttgaggatttctgggttgtcgacctttggggatccttttatccctatttcagttcatggtgtaccagactttcccatttaacagtcccaatttatacttaactggtgtgttcaacagaagttaacagtctgcaggatcatattttactttctacttttggctacctcagctatattatcattattatagaaaaatattggttgtattttatatctcaggataaaaatttagagattaggacttattttcattccttctttgactctgcattggaaggtgaagtcctgtctccaaatattttcgaattctttttcaatataaatggtgtttagattctacgttgctaaaacttaatagtgcccagtgtcctctgttcattttagaattacataagttttacaattataattatagacttttctttcttccaagtgagataaaatgtcttgctagtgcttactctcctaaaattataatatatttgcatacaaataaaattgttatgactgttggaattattttaaaaatgttaatcaaattatctatactagaactggtaacccagttacatatttgtgtctacacctttactttttcaactgcataatatgtgttatgacacttgccttgaggacaccaatgaaatggatatttctaagtcgtttctccaaagtctttagtcctaagtgtcaaattgtgctctcaacttaatttattttgtttagtaattcattgagccctatggctttaaatatcatctttatgctggtaaacataaaaggcataaacttgaattcccctcccctacccatcctgtagtactgacctctccatttggtgagcagtgctgagccattatcctacttattccagccacagcataggaattttccatggttcctctttttctcttactcctgtccacattagcaagtcctattaagtatgcattcaaacaaacaatgtcttgaatcttttaatttttccatcttattatgactaccttagtgcaaaacactatcatctgtcacctagctcactgtaataacctcctactgatttctctgcttctactcaggctttcctcaatcatttattttttaaccaaggtatgtgtatatatatgtatctatgatttaaaaatacattaaagacacaaatcaaattatgttcattatctgctttaaatctgccagtggctttctatgatacttaaaataaaattggaatcagttgcttgtctgcaaaatcctcccttccataccatttcctccatcaccaccatgccatcagtgctagctgttccttctttcaattctctccctcatctttttaagactgaccctcttgtcattaagatctcagactaatgtaatttcttagaggcttttctgactactagagttacctagtcactctgtactaaatgccttattttttctctatgtgatatgttattatttatttttatctctgtatatctctctatcatctatgtaataccccctaatttccagaatataacatccatgagagcagcagcaacctcatcactatttttcacacaagccattagaatactacctgggcttttgatggtgctcattaaatatctcttgtatacatgaaggacatacttttctgctgttttgaattaatactttattttttttttacttatgtagcaaattttgttaatgtgattgcttattgataatggctagtggtcttatcatccaagaatttaaaatatatatatttctgactacatttgtaaatgtcttattcaatatttaaattaacttaaaccttcttgaaataatgctcagagtaatttctactaaattggttgaactttgagagcttctaaaacctgcacatgaatagtaatttatttctgtctagtccaaagttgtttgaatatgacatgatttagcctatttttttagtacatgggatgcttcataacttcaagaataataaattttaattttgagcaccctagcccaaaaaaaggaaactgtcagcactgatctagtttttagtgaattcccctgcaatgaaggactgattgggttgtggttttaaagctacattaattctgtttctaactcttttactttctattttttaggagtatttgttacaggttttcatatctttagtataaattatctttctttatgcaggatacctttctgaaaagggtccgtttaaaatttctaggcaatgtatttttcttttagcatgttaaattagagttttttaaaaagtgtatgtattgaagaaaatacactgtcaaataggagatattcatatatgcattccaatagcaatcagttgaacttttgaataagtactgtagaaaaatatttttctgaatggtgcttttacaaattaaattcatataaatgattcagattttttaccttcaaccttgtcaggatttaaagtattctctttttctgtttccttttggtttcatcttaggtagtagtctttataaaggcatttacatttttcaaaaactttcttgccttagagatggcgtgatttgtcattaaattaattggaactactatatgttgaacttgatcgtaaacatgtgtacaaaattatacttttaaatttggtgatttaccatggcaaatcctatgaagtaggtttattaatattgttgtcattatttattttacagaacagagattcaaatgggttaatgacttttctggcaagatataactatgaagaggcagaattagatttgcattcaggctgttctgtggcagagaaggggaatactaatctagaaacaggcatagactaacgtgctgtgatgtttaatttaactatggaacacagagctcctggggagagcactgacaggcaacccaccaagcttttgtaagtcatgtgctgccaaaattcccctgccctgatgaagagggatctggatccaactcaaaataatatggtaggagccttagtcacatattcagacctgagtataaaggataaaaacaaataaatttgagcctatattttcagaagtctctgtaagctaggtgataagttatgactgttatgatactacagctgctactactcataggggattagttgccaagaaaagaacaaacaaacaaacaaacaaaaaactcaggcaatctccctatctgatgaaacaattcatttcactgcaaaaggaatgaggtcccagttttctcaccattcccaccacagtcatgagaattcatatcacaaaggtggtggtctacagattctcttacatgctttgaatcaatggggcacacaacttgaatacctaggctcagaaatctagaggttgaaatgtcttttatttctttctgtacgtaggtaggatatgttatttctttgttattactgctaaatatatagtgtgtattgatggtgatcacatttaacattgagtgtactgatttcataaaggaaaaaaagaatacctgggtggtttgtcactgtactagaggagagatgggcctcccctggattgaggattatagtcagactattggcaagaattttttgaaatggcattatgacatttttttcgagatgaagggttgcataattttgtgttgtcacgtgattggaagtggtgaagatgcatttatagtgaatccaaataggaaggtgatgttaaataagaggcatccttggcactctgtgcacaggaagaaatgtatgtgtgttggaaatccaagggtagaatatccatcatagtgtctgccattttcacatgctgccccctatcctgattcagttggtggctacagataaacatgtttaaatttcaggtatcttgactctcttgagcatatataattggacttggggatgagaccctgatctaaggtagggagttcatagactgacctacagagcatgacgtggactcttgtaaagggatatgatgtgtctttctcttagcaagtcaaactagaaaaaaaatagtttaaatcaggctgtaatgagaatagaaggtgaaatgatggagcagatttacggaataaggatcaatggccattggtcatcccaaatcatgagaaaatagaagataattaataaggaaaaataataaggtagaggctgggtgcggtggctcacgcctgtaatcccagcactttgggaggtggaggagggcggatcatgaggtcaggagatcgagaccatcctggctaatacggtaaaaccacgtctttaccaaaaaaatataaaaacttagcctggcgtggtggcgggcacctgtagtcccagctactggggagtctgaggcaggagaatggcgtgaacccgggaggcggagcttgcagtgagccgagatggcaccactgcacgccagcctgggtgacagagcaagactctgtcaaaaaacaaaaacaaaaacaaaaacaaaaatcaggtagaaaacagctttgtaggatggaaaagaacaaggcaggtatttgatttagaaagcccatatcattaggaatagagaaacatttggttacaaaaaatgaccgtacaatagagtgaaggtctatatggcttttcactgctgttgaagtctgtagagttcattgaatcctaaatagtgtttcagtaccagttcctgtgaagctaaaccatattagattaatattctttgtttctttttgaatgagctaatattcctttcctctcaagaaagagaactaaatctgaattgcttaatttaaacccacaatttatttaaagattttgtcaaagaaaaagtgcattggatagaatgaaacaggcaaggaacgttttattcaattgtaatagaggtcaaaattattgcagtaatggagattgaactcaactcctttgaaacaaaaggcaggtcgatttttaagctctggggtgagctaatggaaaagtactacagaatgttgtggggaggttgtcaatgtgattagcccatttgtgtttgctaattgatactttttgaagttaggcccctactcccaaacagagactagcagataggggctgtgtctttcttgatgattatatttcaaagagatagctcttgggtgcttgagaaggacatttctgggttgtaaaataacaaagaggctggggaaaaaattacatctcaagaagcagagaaagaatttacagttgtaagtgttctaaaataaatgctttaggaaaaagaaggtcggggcctatcttcaggaagaagcctatctaaagtttggctaagctgaggtaactttaaggttaatgctgtcttcttcaattaccagaggaattcacagatctaaaaggtgttgccaaccaaacttcagaatggcaggaagcagaaagactgcaggtaccttggtggccagaagtctgtatgttttccccaatacaccatcattaagatgtcatcgttttctgtcctttgaaaattaccaggagcatcctttgacccaatttagatggggtgcgtacatattcattcattcatctgacaaataccaagtatctacaatctaccagatactgttctaagcactagggatatgtttatcagtgaacaaaatgttcaaaattctccatactaatgaaactcacattctagtgggaaagcaacatatagtaaccaaaataagtaatacaagtatatagcatgtagatggtgttgttttgtaagcaatacaagtatatagtatgtagatggtgttaagttttgcaaagaaaattaaagcaaggaaggggaatataccacatctacaatgttatagtccaatgtatggacccctagccactctggggctattccatgcatattctctgggcaattgctaggtatgagacaacacttatgacatggggaaataaccaaattggtgtatgttacacccttttgacttctatttctatgctatacaggctcattatttaccattaatttgcaaattaactgtcttaatttaagataattaaatgcatattaaaaatattttgaaaggctgtattataacatactagtattggtttactaatttagttgattggaaggttatgggtcatattttggtctatacttcttcatattttgtacattttcatcaatgggcatatttttaccttgataattagaaaatttttgatactttaaaagtttagcttcttatataacttaatcatcatcattataataatcacttttagtactaagcactttcttttttatcatcttatttaaaacctcaaaaatgagtctagggaagttgaggctagaatataaaagacctagtatgcacattaaagttttgacaataagagaaaattgaaagtgtttaatgtgaagactggcattataatatttattttgaaaaaaattaaaaaaacctgtaagttacacccagagtggaatgatttggggaggaactggagttgactatggtattgatggagggagacatgagtatagttacagagggaaggaaatagtagggctttgctaaagagaaaggctaaggagacattttggaacgaatgataaccaatatttcatttaactcacacttctgtaacaggggtgtccaatcttttggcttttatgggccacattggaagaagaattgtctttggccacacagaaaatacattaacaataatgatagctgatgagctaaaaaaaaaaaaaaaaatctcaaaaaaatctcataacgttttaagaaagtttacaaatttgtgttgggccatagttaaagtcatcctgggctgcatgtggcccacaggctgtgggctggacaaggctggtatcgaaccaaccttatattcctgagtgagagggctctagactgaaaactcccaagccctcttgatactgagctgtccatcatccccaaattccaaatgcctatatggatgaactccatcctcacatgtgtttcacatttttacagtgggatttctattatttttatatatttattttgcaaattatagtaaaaatttatcagttttaaaaacaaaaggaaatagttgaaaaacaaaggtctgcaagttgattgaaatactatacttttgctgtaggggagccattgtagttttaggaagttgtgttatattagtttcacctccattaaggcttttaacccagaaattcctctttttaaataatatcaaaacaatttccagtaaataaacactaggtgcaaggaaaataattatattagtatgatttccttcaaatttgttgagaaaggaggctccatagccttcgttctacagatgatcaactttgaaaaacagtggtaatgtggctgtatgctcgcatatgtcttttaattgactagttagctatttacttttctgcttgttgatgactttcctaattgaatagaaaagctatagttacccaccacaatataaaatattgaaaggtgatggagaaaaagcactttactagtctcttgggaaagaaaattgcatattgtgtctgtaattattttgctctctgaagaaatatatcagactgccatttctacatcaattttctggatatcgtgggacccattattttaatgtcaacagaaacaagctcttgtagagtttctctgccttttctatgctccagttaacctgagggacctttaagctataatttatagagaaagacaacagcataacacaaatgagttagagattgatttgtaagtcatgtaaggcatgcagagtaacaaatcgtggaccaaggcaatgcagatcagaaaagaaaagaaaaatctgcactcatcacactacctaaaagtggacatgtaatgggacgttgatttaataaatgtcacgaaatttcaaatagaccaatacttaaagcctgtatgagaaatataactaattgtttatccattcaatggctacttatagctcaactataatggggtcagacactgtgctgtgcaatggagatacatgagtgagcagagtagatgtggcttctgcacttacataggattgaaaatgaaataatcaatggtgataacatttgtagactatactttgagagctgtacaagaacatctcatttctttttgggagaccgtagaacaaaagtgcatgaaaaataagtaaggtggttaagtaagcagaaggtttagggagcattggaaagaggtaaaattatatgggaaggccagagagacaagtagtggcacggaactgaaggaagttcaggatggctagaatatggcaagtgttgagacgagtggagagccaggcaggcggcaggcagcaggctttgtatgacctgttaaattacaactgacacccaaataagtccaagtgcattcgtctttctaggattatttatcaaattcctacattttttcaagctgtttaagatacaaagattaaaaaagaacgattttttaacctatcgcatctccaatttggtgtaatagaaagtgaaataaaaggatgacagtaatacagagtaaaaagtgatatgaatgtaaaagccagaagctgctaaagaaacagaagaaggaaagtcaggaggaaggtctagagcctgagaaagacttaagaggtgattcttgggttgagtcttaaaggccatcggaagctggtgaagcagaggagggaagaacagttgaggcagtagtaccgacgtgtccagtggcttagaagcacaaggaacaagatttgttcagaactgcaaggggaatgcttttattacagtagcatttgtcaaagtgtgcctcagtaaacaatctgcaagaggatctggagacactctgtgtacttcttggaaagttacaatgcctattagtgcagtaagggatctgaaaatatccacagtggggagtgctgtttaactttatttcatatggtgtttttcagaacaatttgaccacagaatttcctctactgtcttcttttagtttaaaacctattaacattcattaaatacaccttgaagttgatattagaacctagactgggtggtggaggaggtcagaggatggggctacagaaggtcagatcatgaagaccttggtctgccaggcagatcgttagtgtagaacgcacccatttccttccaggtgaaaggtactccattgatgtggcacatccaactttactcactccacgctaatggggttgtggggagtgattcatatgaaaggtaaatttaggaggagttaaatgagagtatcatagctgtaccattcctcctcttggagtgtgctgccagctgggagcacctgctccaggtgggaagatttgctctagttcagcaccacctgggtctgggagggcaattttcctcttttgggattcaatattaagaggtgcatttgactgtaagaataaacaatatttccaacatagtttcattggcaataagggagatgtcttagttagccattcctcattcattgttttatttctcaatctcttcaacattttttataggcaaggaggtgatatgtgttgaccttcatgagatccagatattgaggattttgtctttatcctgtagataattgggaaccactaaagtattttaacagaggagtgacattgccagatttgcatttgacggcttagatagcagtgtagaagatatattaaaggaggaataaatagagtctgagaaaccaatctaaaaggacagcagtaatccagacaagaattaatcagatcttgaactacatcaatggtagcaattcattggagaaggggatgaatatggaatacacataggaggttgaatgaacagaattaggagactgattagatgtatgatatttgagagagacaatctagcacaactctcagatttctgaatagagctggtttgcattaattttggtggaaatgaaaaactagttctagcagactgagtgggcatgccttaggaatccaactggagatgtctaggtgtttgttgtatatacctgtctgcattccagagacatttatagtctagaaatacagacatggcagttgttgattaattcgtggtactcaatgtcatgacatcaatcaggttctttaggagggtgtgtggaacaagaatactacccagtatcaatactgaatacttattacatgcccactatgtaccagcattacattaaacactttacacacatgctctcatttaattctcatgaaaactttttaaggtgagcactattacactattatcatcactttccaaatgaaacttgggaaaacagacggactagaaatggcatcctaggaacactaacatttacggggcagttgaagggaagaaataaacagtaagaaaagaaaaagtggttgaagagaaaataacttttaacacgaagcatggtgctgaaataaaagaagaactggtcaacaatttcaaatacttcatagatgtgaaatagaagctgaagagtttccacttgatttggcaactaggaatcatatttattgtgttcataaaccttcccatgatatataatatatacacacacacatatgtcactctgtcacccaggctggagtgtgctgctatgatctctacttactgcaacctctgcctcctgagttcaaacgattctcgtgcctcagccttccatgtagctggaattacaggcacgtaccatcatacccggctacatttttttatttttaatagaagcggattttgtcatgttggccaggctggtctcaacccctgacctcaagtgattagcccaccttggcctcccaaaatgatggatttgcagccgtgagccaccgcacctggcctcccatgatactttaaaaatacttgataaaatacacttgtattcagtaacatacacagatggtctttgtggtttgctattttaattattttttacaggggacgtatattcagagagttttgctatgcaatgctctttgacaaatttaactttattcagggttgggggttaagcctgctatgggattaaagaacagaaaaccacagggctctcattctcttattgtttcttctattaagggtcaaattcaggagcatagtgtacaatagcaattattcgtcagaaactcagttccctgttagaattctactcagaaagtaaatagaaaaaaaggagaattctatatgcatttgggggaagagacatggtcgatgacctagaatttgatgaaaatcacctacctgagagtcagattgattattaaataaattagcaccaatcaaaacttctaaggcacagagctaaatgagcttatgaccctgtacattgagggagttattaggatgctaaatcttagaacaagtctctgcatgcatgagttttaatgaagcagatgtacaagcagatgaacattattttaagaagcaatcctctccaaaaaacaagataatattgtagttttatcagcaattgtttacataccacttgatttctagatttaacgctgattaacaatgcactttcttttataatctacttttttatcattggtctggctaatttataagattttgtgtctgtgtgttccttctgaaaacagtagaaaaatgatattgtaacaataaatatggagcttacacaatgggaaacaaggaagagaaatcttaacatcaatggcagagttaatgtagaattgcagaatgcaggcccaaagtaataaggataaggtgacaatcttgatctggttaagagatatatagtacctcacgcattatgactgtcctgttacttggagtcgttgacaactgactaaacatagggacacatttggtattcttttgcattcagcagaatgcagcagaataagcttggcagatataaaaaaacatttatgttcctccttctgcccttctccatccccttttgaagtgcctatacacaggggctttgcctggggatttcccagggctcctcctgccaaacaagctcaggcagggcagaggggtctcaaaatcctgaggacttggttgtgaatttggagtctgaattatttatctgttttcattcctagcacatttgcctatttttttcttttattcaaaacagtctatttaatttctgaaatgcaaaagaatgtttggcatggataaatagctgtgatttctctctctgataaatcttgcaatgttagagtttaccaaagagaacccacatattcttgtcagtagcatgggctttggagtcaggcgactaattctagatttactgcttattgctcatatgagtatgagcaagttactatactactgattctttttttaatgtctaaaattgagttaataatgtttagtatatattcatgaaaaatataaggagttattgtgtacaaagtgcataagacagtgtctaatcctcagaagacactcaataaagggagtctaccttagagttgagctgtcttgagtccaactacctgggataaagtctggactccatacctagcagctatgacttttgctaagttatataacatttctctgcctccatttccttgtttgctaagagggattcataatagggtctactgtgtaagttcatgagaagattaagtgagttactacataaagctcttagaacagtgctagacatagtaaaatcttaataaatgtttttgatgaaattgattatataaaaattactatcagcatgcagtgctgtcaaaggtataatggaaaactataatgaaaacttgatttctatccaaggagcttgtgctaaacagcaaatgtgttcatttttaagggttcactttcctttcctcattacttttgaactctgttcattacatttgaactttgtctagtgctttgaaatgtgaagatcaacataattttaatgatctcatcaactttatgcagtagatacccctctgagcctgggggagatgggagtttaaatccagagacagacatgtctgtggtcttacagcaaagtaatggatgctctggtactgtgtttatggactttttacactgagtccactgcttagtctgattagttcacagtccttcataaagaatgtgagcatgctatccatccaagggtttatataaactacaaagacagcaagcaagaactaaaacagaaccatttttaatgcacactttttattgttaatgcaagcgacatcatgcagaaaataacatatctcattttccaagcaatttaatggtcttccagttatcatttgacaggatcaagctataaatctgtttttatacaatttgaggaaggcttatggaatccattatttatttcatttttttgtaagatctaagtaatattttttgtagttaatgagctgccaaacatttagttttcttagtaaaatctgagtatatcattttacttgttgaattttgatggatacttatttgcattagattataaaaggttaatactgaatttcaaatcagtgcagagtcagtttctattagtacctgccatcatccttgctagtgcataatccttcaggctatataaacaccagtggcctttcttgatttaaatgaagcagagaaacattgttttagttcagccctaaaactgaacccctcatataatttctaggagttttcatgggatataaaaagagaatggggctgattcagatattcttctagctcttatggaaggtaaaattaaaacaataaagttataattaatgaaatacaacattgtgcaatggagagtagagctcttgcgatagctcctttgtcttggagggctctctgtgcctggggtgggataggatgggaggggaagcttttgcacttagatgactttcttcacttttggggcatgataaatctgtgtcccaccttttaaggtagtgatgctggatgaccagtatcacatctgctatagttggactgctggtgtggaaattgctcttttggactcagtttctgatgttatctgagtagcacctctgcagccaacctaaggcaagaggtctacccctggaaagcatcctggctgtgtcagggctgccagttcttgggtctgcatttctgcttccaaaattgcttgtgcacttattcctggctgttgggagctgcttctcatcagaccactgcacaaggtgtcatttcaactaatgatatagtagcatttatatttaaagggggtggatatatttttaatattttaacagatacatagctttttttttttccagaaacaaccatacacaccaaccaatacagacaatgacaacaaggctctccattaggatgaagcctcatatctgatgtttaagtccagaaaatgtcattcctagatatatatacacagatgtgtttttgtatgagtaaattatcaagtaaactataatttttaatatttggaagatgattatcatatcatttgaagtgcttttcactgtaagttacttttatggaaatagtattgtgaaaaaacttatttcttaatgcaacttataagaacaaattcttatgtattttaattttatttttaaaaactatatttttctgaaatatgttataaaatatgttaaaatatgtctgtcacaggtatagattattaaaaaataataaagcttttatctgctttttacaatacatttttctttggctgtagtctataatatcattttatcataaaacaaagcccatcaacactatctaaaactagtactgaaaaagaaaaactggtatatagaaattctctatgacttcgtttgtttcagagtagcatttgacataaaggtcaacattgactaagcccttgcattatcaatatattcttccagaaaaattttggcaacaacataaaacaataggatgttttaaaattattaataatttcataatctgctttaaagatagtctttgaggaagactttctctaaggaaatacctttaaaagtcaaaataaaaatctgtaatcctatctgcatggtagaatcaaaaggcactgagtcttgaactaataagggatagggggaggattcttgaagtacatgaaacttcatttatactatttttaaaaaaaacagaaaataccataaccagacacagtgccccatgccagttacaaactccaggatgtattatcgtggagaacactctttgatgattggctatgtaaaggtgaaagtggattacacattttggaactacaacagggtgtattttctatgacacaaacatctcgtgttaaggaattggcttaactgttctaacaaaaaggtcttaaaatgaagtggcatcatcaatgttgtcttcattgttatcatcatcatcatcatctagattttatttttctcttgtgtgacagattagagaaaagaggtttgggctggagggagccaattcttcatgaggatattcaaggactaaatttgcttccattatgttgctctgtcatttcctgggatatggtcctggagtcaagggagaatgacaggttaccttcacatatgttttctagcctgcaagcaaaaaagaaagagtggaagtgaaaggaaaacagtttaccctttatgcatataatatggaagttacccacatcaccttcatttagtggaatggcaagaacttacaatcgtagatgcaaccagctggaagggaagcagctatggcacagctaacgcttgcagatagttctaccacaaaaattatgaaaggaagactgatacttcacaatctgttctacacttcttaataacaaagcaaggttgaagaatatcaaaaaggactaataaaattataaaatatggatgacctgtttaataaaataaatagagaaggtggacagcaaaattattaaacagaacaattaagtacacataaaatcagtctaaagttttaaaaataggaaagatagagatcttgaattgttagaaataataaatttgatgagttttaggttgactgaagaattctctgaagattttaaaccaatttctacagtactcagtataacttattcagacaatgtattttgtcagatatgccttacaaaagtaattcaacttatgtaagcacatatccacatctaagtactgaagaaaataatgtcatattgttaaaacagagtacacatttcactagtttattcaacatggtaaagctcttgaacaaaaaaggtctttctaaaacacaatcttagattcttattttttgcctacttcttttgcatgaattagaaatgtaaaatcgagagtaaaactaaagacaaaaatatgatgataatacgatttcattagattatgaaacaatttcaaacttacgtcttggtgtgggagaattactctgaacagggactcttcatggagtccagagatactgggagtcttcaaacacatgcaaagtctttctaaaacataatcttagattaatattttttgcctgcttctccttttgcatgaattagaaatttaaaatcaagaaaaaactaaatagagcatagaagaatttttctaaatttggataataatgcttagatataattaatactcagaatatgttgaaacagaaaatgataaatgattgtacattgcagctaatagtatttcaccatttaattattcaatttattaaagctttgtgatggtaaaattgtatttaatcactaaggtttattttcttgctgctctcaccattttaaatatttgaaaatgtctgctttaagtatctgcataagttggagaaatattaactagcataaagtttattttttaattttaaaatgatgctgatgataattttgtggtagttgttttccctgttgatcataaattgataaaaacatagaggttttggatttaataagagacagatgctgtctgaatccatttgtgctgctataacaaaatatcttaactggataatttgtaaaaaacataaattaatttttccacagctatgtaagctggaaagcccagattaaggtgctgcctggtgaaggcctgatctctctgctcccaaaattgtgtgtcttgatgctgcttcctctggacaaaaggaatgctgtcttcatgtgacagaaggcagaagggcaaaagggagggaagtgctatggtttgaatgtgttgcctccagaattcaggtgttgccaacgtgatggtagtaagaagagagacctttaagaggtaattaggtcacaaggactccttccctcctgaattggattaggtccccttataaaaagacttgatagaaagagtttgtctcatttttcctttctgctttctgcaccatgtggggcccagcattcctgtcctccaaaagatgtagctttcaaagcaccattttgggggcagagagagcagccttcaccacataccaaagtacacagtcttaggtattaatattttgttatagcagcacaaatgaactaagacagatgttttcttgattagaaagatgaaaaagtagattgaactaacaaatgtacaatattttggtattaataacatctcatttctgagataagctttgtaacataatttgaaatcaggaagtgtgatgtccccagctttgtttttcttgctcaagattgctttgcctattcaggatattttctgcttccatatgaattttagaattgttttttccatttctgtaaaaaaaaaaattagaattttgatagagattgcattgaatctgcagatcacttcaggtcatatgaataatttaatattaatttcttcaacccatgaatacaaggtatctttccatttatttgtgtcttcttcaatttcctattcaatgtgtacagttttcttacctccttggttaaatttattcctaagtatttaaaatattaaatatttttttgttgctgttgtaattgacattttttaaaatttctttttttcagatattttgttagtgtatgaaaatgcaactgatatttgtaggttgattttgtttcctgcaaatttattgaatttgcttattagttctaacagtttttttgttggcgtctttagggttttttttaaatataagattatgtcatctgcaaaaagataattttactttcttatttggatgtctttaatttctttttcttgtataattgctctcattaaaacttttactattatgttgaagacaggtgagcatccttgtattgtttttgatcttagagaaaaagttttccacattttactgctgagtctaaagttagaggtggtcctgtgatatatggtctttattgtattgagatactttcctcctgtacctaatttgttgagaatttctatttttgaaagaatgcctagttttgtaaaacgctttttcagcatttattgaattgatcatattatttttatcctttattctgttactgtggtatattacattgttgatttgcatatattgaatcatctttgcacctcagggataaatcccacttaattatgttttgtgatctttttaatatgctattgaatatggtttgctgatatttcattgagtttttttgcatccatgtttattagtggtaatggcctgtaattttatttttttgtaaagtctttgtctttgctatcagggtaatgctggcctcctcaaataagtttggaagtgttgtctcttcaattgtttgaaagcagttgagaaagattggtattaattttttttaatggttggtaaaattcaccattgaagtcatttgaccctagatgttttttcctttttgttgggaggtgtttaattactgagtcaatttctttactcattgattaatctcctcagattttctatttctccatgaatcagttctggtaggttctatttttctagaaatgtatccattcttgtagcttatacaatttgttggcatataattgtttacagtagtttttttatgatcttttgtatttctgtggtatcagtcgtaatgtctcctctttaatttataattttatttgaatcttctttttctttagtccatctaaagtttcataaattttgtttatcttgttaaaaaatctcctactttcattgcttttttctgttgttttgctagtctctgtgtcatttacatatgctctaatatttattactctcttccttctgctaactttgggctcagttttttcctttccacattccttgaggtatgaaggtagtttatttatttgagatcttttgttttacttaatgtatgcattgatagctactattttttttcttagaactacttttgctgcatcttataagtttgatattttgtgtttccattttcataagtcacaagattttttttttacttctcttttgatattttcttttacccattggttgttcaggagtgtgctgtttatttccacatattgtgaattttccattttttcctattttcatcctatcatgatctgaaaagatacttgattaaattcagtctccttaaatttgttcataattatttgtggcctaacgtatgatttattctgaacaatgctctgtgtgcacttaagaaaaacatgtattctgctgctattaaatggaatgttctgtgtatgtctgtaactccatttggtctgtaatgttcaaatctgctgtttctttattgattttctgcctgaaagatctatctaatagtgaaaatggggtattatagtcccctactgttattatattgctgtccaattcttctttcagttgttaatatttgctttatatacttaggtgttctgatgttgggtgaatatatatttacaattatgtcctctcaatggatcgacacttttgttattataaaatgaccttgtttgtctcttgtgacagtttctgacttaaaatctatcttgcttgttacaagcgcagccacccttgctttcttttggttaagatttgcattgagtaggtttttccatcccttcactttcagcctatgtgtccttaaagctaaagtgattttctagtaggcgcatatagttggatctcgtgttttatgatcagccactctgtgtaccaagactcattcataactccttctttaccctagcactcacaatgaataagtcactaaattctgtctaaacttttttatttttttgcattaccacttggtttttatttatggacgttcacctattgtttatttgccgtcatatataaagcattattataaacaaattttttgtctacatttttatgtcctaaatatatctctctagaagtaaaatttcaaagtcagaggatatgaacttgtggagcaaaatacagtttctaggcattgtgaaattataaaaatgaataaaccgtgactctgagatctacattcacgtattgaattgtcattttgaaggccttataagggcatcttctaccatatctgaaataaaactaactcttggtttcctctgctgatctgtcccactaataaaacctcttaaactgttctttttcccttcctctctctcaataaatgagactaggaattatccagatgagtaagtgacaaacctaagcatcatacttgatgctcatacattctgtcccttttacaccactgtatcagtaagtcttttcaggtccatctccaatatatatcttggatctgtctgcttggttccatttttactgatgtcgcttgtctccaggtcaccatagcttctcgctttgatacttcaatagcctccttggcaggtttgtatcttccactacttctgcatgccagcctagtatttacatagctgctgaaatgctcttttcaaaacacaaactgatttcatttgttgccccattaatctgtttattgacttagcattgctcttcaaatagaatctaaactccttaacaatgttacacatggcctgagggatctggcccagctcagtttctcaatgttcattatttccaaagtccagcccttctcacagttctctggctctttcactttcttgtcagttcctctttgttcctcaggttttctgatatttgcacatgtttgtttctatttggacagttctttcctaactaggcttgttacaaaattttatgacagcctccgttgcatattttgtttacccttgcatttctctgagagatgcctgctatgaacaccctatgtcaggcattctgcaaccccaccacaaactcataattgttctattttccagtatagtatgtaactatatatttaatttttttattacaaagggaattatatcctatgctcattctgtcattttgaacagttctcaaagttattgctgaagcttaaccaaaatgaatgtagatagcaatgtgaccatataaaatattttacatttttgattgtagaaataatatgtttattgcaaaagaaagtaaaaaatacatggaaatattaggataaagtaatatttaccttaaatcccacaactttgatattgtaaccattaacacctctgtgcctaccctttcaaatttttatttttatattcaatcaagcacatttatacttaaataattgaggttataacaaacattctttgtttctacggacatttctttgacacgtgtataatctgcagtgatcaaatcagggtacttagtatatcgaacacctcaaacattgatcatttttttgtgtcagaaacattcaaaatctgctttctagctatttgaaattatacagtaaattgttatgatcatccttcaattatacagtaaattgttgttatgatcattctatacatccttcagtgtatagaacactagaacattttttgttgttgttgttttgtttttagatggagtctcgctctgtcacccaggctcgagtgcaccaaatatcaaaattttaaatagacagaatttttatgacactgcattttttttcagtgggtttaacttcctagcatcccatgctttctgaaccacctggtggtctggttctcgcaaggtggatttataagagttgacaatggtatgtgaaccaactggataatgcagggctttatacatactcatgtttttttattatataatttttattaagaggttttattttccacttggatcaaaatatgggaggatatttggtaagtaaatatagtcatgtgtcacttaacaggagtaattctgagaaatgaattattaggtgcatttttattgtgccattttattggcattattattgtgccaatgtcatagggtatactttacacaaacctgataatacagcctaatacatacctaggctatataacatagctattgctcctagattgcaaatctctccagtatgttactataggttattgtaacacaatggtaagtatttatgtatctaaacatagaaaagatacagtaaaatatggtattataaactcatgggatcactgctatatgtgtatcccatcattgaccaaaatgttgttatgcagtgcatgtgcatgactgtatatgtatgcacagttttatttttgcttcagtttgccttctggatccacactggcattgctatggatccacatggcactgctagaagaataaatatatgaacacatttaaacatccataaagtatgattgcgtatctatttaaattagttttttatttttattttatgggttcatagtaaaagaatgtatttatgggttaaatgagatattttgacacaggcatgcaacacataataatcacatcagggtaaataatgtatccatcacctcaagcatttattctttgtgttatgaacaatccaatatactctttcagttatttttaaatgtaccattaaattatttttgactatagtcaccctattgtgctatcaaatactaggtcttatttatcctttccatttttgtatacccattaaccatccctacttccccacccccgactccctctgctacccttcccagcctttggtaaccatccttctattctctatctccatgagttcaattgttttgatttttagctcccacaaataagtgataacatgcagtttgtctttctgtgcctcccttatttcacttaacataatgacctccagttccatccatgttgttgaaaatgacaggatctcattcttcttttatggatgaacagtactccactgtgtatatgtgccacatttttaaaattcatctgttgatggacacttcagttgctccctaatcttggctattgtaaatagtactgcaataaacatgggcatacagatatctcttcaatatactaattttctttcttttaggtatacacccaggagtggggtcgctggattgtgtagtagcaccctttttagctttttgaaaaatctccaaaccactctccatagtggttgtactactttacattcccattaacagcataacagggttcccttttctccatgtcctcaccagcatttcttacagcttttggataaaagccattttaactggggtgaggtgatatgtcattgtagttttgatttgcatttctctgatgatcactgatgttgagggccttttcatacacattttccatttgtatgtcttcagatattgagaaatatctattcagatcttttgaccatttttaatcagattattaggtttttacttacagaattgtttgagcttatatattctggttattaatcccctgcagatattttctcccattctttgggttgatacttctttttgttcattgtttcctttgctgtgcaaaagctttttaacttgatgtgattccgtttgtccacttttgctttggttgactgtcctcgtggggtattactcaagaaatcttcgcccaccctaacctcctcgagattttcaccaatgttttcttgtagtagtttcatagcttgaggtcttagagttaagtcttcaacctattttgattttatttttgtatacagtgagatttaggagtctaatttcatttttctgcatatggatatccagttttcccaacaccatttattgaagagactgtcctttccctaatgtatgttcttgacacctttattgattatgaatttactgtagatgtgtggatttctttttgggttctctactgttacattggtctatgtgtttgattttatgccagtaccatgccattttggttactataattctgtagtataacttgaaatcaggtaatgtgattcttccagttttgttctttttgcttaggatagctttggctattgtaggtctttttgtggttccatataaatttaagaattgtttttcctgtttatgtgaataatgtcattagtattttgatagggaatgtattgagtttgtagatgtagattgctttgtgtatttatggacattttaacaattttgattcttctaatccaacatggaatatatttcaattttttggcctcttaaatttcttttatcaatgttttacagttttcattgtagagaactttcacttctttagttaattcctaggtatattttaactttatttgtagctattgtaaatatgattattttctggatttctttttcagactgttctctgttagcatatagaaatgctactgatttgtgtgtgttgattttataacctgcaactttactaaatttgtttatcagttctaatagttttttggcagagtctttatataagattatatatattccaaatataagattatatcatctgcaaacaaagataatttgacttcttccttttcaatttggatacccttaataaactttctcttatctgatcgctctagctagaacttccactactatgttgaaaaacagtggtgaaagtggggattcttgttatgttcccaatcttggaggaaaggcttgcagtttttcccaatcttggaggaaaggcttgcagtttttccccattcagtatgatactagctatgggtctgtcatacgtggctttcattatgttgaaggcatgttccttctacacctagttttttggtttttgttatgttgaggcatgttctttctatacccagtttccttgtatacccagctttttgagtatacctatcttgaagggatgttgaattttatcaaatgctttttcagcatcgattgaaatgatcacatgttttttcccatcattctgttgatatgatatattacattgatttattcttgcatatgtttaaccattcttgcatccctggataaatcccacttggtcatgatgaatgatcttcttacggtgttgttgaatttggtttgctagtatttacttgaggattttgcaccaatattcatcggagatattggtctgtaggtttttttgtgtatgtgatgtgtctttgtctggttttggtatctgggtgatactggcttcacagaatgagtttagaagtattccatcctcctctattttttgtaatagtttgagtaggattggtattagtgcttctttaattgtttagtattaatagaattcagcagtgaagatatcaggtctcaggcttttctttgctgggagacattttaatatggctttgatttcattactttttgttctgtacagcttttcgatttattcctggttcaatcttggtaggttgtgtgtctctaggaattttgtcatatcttctagattttgcaatatgttggtggcatatagttcctcagagtagccactactgatgctttgaatttctgtggtattggttgtaatatctcctttttatctttgattttatttgggtcttctctctttttttcttagtctggccaaaggtttgtccattttatctttaaaaaaaaaccaactttttgttttgttgatcttttatattgtttccttggttcaattttatttatctctgctccaatttttattatttctttttttctattaattttgggttttgtttgttcttgcttttctagttctttaagatacatcactaggttgtttatttgaagtttttctttttctttttctttctttttttttcttttttgaggcagagtctagctctgtctcccaggctggagtgcagtgacatgatctcagctcactgaaaccttcatctcctgggttcaagcaattctctgcctcagcctcccaagtagctgggattacaggtgcccaccaccacgcctggctaatttttcttttttttgctagaaatggggtttcaccatcttggccaggctgatcttgaactcctgacctcgtgatccacctgttttggcctcccaaagtgctgggattacaggcatgagccaccgcgcctgggctgaagattttcttcgcttttgacttacagctatacacttccttcttggtactactttcactgtatcccaaaggttttgtgtgttgtgtttccattatcatttgtttcatgaaattcttcaattttcttcttaatttcttcaatgattcaatggacattcaggagcatattgtttaatttccatgtgtttgtatagtttccaaaattcttcttgttattaacaagaagaattcttgttaataataataagaattcttcttgttattaactggctttctttcattgtggtcgaagaagatgcttgaaattatttcagtttttctgaatgttttaagactggttttgtgacctacatatggtcacatgtcaagaataatccatatcttgaggtaaagaatgtttattctacagctattggatgaaatgctctgtaaatatctactgggtctctttggtctatagtgcagactaaacccgatctttctttgttgattttctgtctggaagatctgttcaatgctgaaagtgggtgttgaagtctccaggtattgttgtttgaggtctctctctctctctctctttagctctaataatatttgctttatatatcttggtgctccaatgttacgtgtatatatatttacaattattatatattcttgctgaattgacctgtttatcattatataatgatcttctttgtctcttgtattttttgtcttaaaatttattttgtctgatataagtataactactcctgttctttttttcatttccattggcatagaatatctttttccattcctttattttcagtctgtgtgtatctttataattgaagtgtgtttcttgtaggcaacagattgggtttttctttttactgtccattcagacattctatgtatttttattagcgtatatagttcatttacattcaatgttattattgataactaaggatctaattccttccattttgttatttgttttccggttattttgtggcctttctcttccttctttcttttctcccttttagtgaaggggatttttctctggtcatatgatttaattttttgccttatatttttgtgtatttgttgtatattttttacttgaggttaccatcaggattgtaaatactaccttataaccattattttaaactggtaacaacttaacattgcttggataaacatacaaattaactatgaagcaaaaagaaaagtaaaaaacactacacttatctttgtcttcccactttttaactttttgttatttctatttatatctcattgtaatgtctatgtcttgagaagttgtagttgtttttgattggttcattatttggttttactacttaaaataagaggagtttacacaccacaattacggtgttataatattctgtgtttttctgtgtacttactattgccaatgagttttataccttcagatgatttcttattgctcattaactttcttttctttctgattgaagtactccctttagcatttcttgtagcataggtctggtgttgataaaatccctcagcttttgtttgcgtgagaaagtctttatttctctgtcatgtttgaaggatattttcactgaatatactattctagggtaaaaagttttttccttcggcattttcaatatgtcatacctgtaaggtttccactgaaatgtctgctgccagacctattggagctccattatatgttatttttttttttcgttgcttttagtatcctttctttacctttgggagtttgattattaaatgcctttaattaatcttctttcagtaaaatctgcttggtgttctataaccttcttgtacatggatattgataactttctctaggtttggaaagtttctgttattatttctttgagtaagctttctatcattatctctttctctgccttctcttcggggccaataactcttagatttgctcttttgattctatcttataaatcttgtaggcatgcttgtttctttttatttatttatttattattattattatttttgatggagtctcactctgtcaccaggctggagtgcagtggcacgatctcggctcactgcaacctccacctcctaggttcaagcaattctcctgcctcagcctcccgagtggctgggactataggcgcacaccaccaggcccagctaatttttgtattttttagtagagatggggtttcaccatgttggcctggatggtctcgatctcttgacctcgttatctgcccgcctcggcctcccaaagtgtcaggattacagacgtgagccaccacgcctggcctcttttttattcttttttcttttgtcttctctgtgtattttcaaataacctgtgttcaagctcacgaattctttctttggctgataaattctgttattaatagatttctgatgcattcttcagtatgccagttgtattgtttaactctaaaatttcttcttgattatctttaattatttcaatctctgttaaatgtatctgatagaattctgaattccttctctgtgttatctttaatttctttaagtttcctcaaatcagctattttgaattctttgtctgaaaggtcacatatctctgtatttctgagattggtccctggtgccttttttagttctgtcaggtcatcttatcctggatggtcttgatgcctgttgatatttgttggtgtctgggcattgaagagttgggtatttattgtagtctttgcaatctgggcttctttttttaacttgtccttatttggaagctttttcaggtattgaaaaggacttgggtgttgtgatctaagccatgccttcattaggggaaccccaagcccagtaatgctgtggttcttgcagactcatagaggtactgccttggtggtcatggataagttcaggaagaattctctggattcccaggcagactcttgttctcttccgtaatttctcccaaatcagtgaagtcttcctctctgtgctgagctgcctggtgtggagactagagtgacacaagcaaccctgtggccactaacactaggattgcactgggtcaggcctgaagccagcacagtactaggtctcactcaaggccctctgataacacaccctggctactgcctgtgtttgctcaaggccctatgtctctacagtctcaggtggtaaagccaactaggcttgtttccttcgcttcagggtgttgagtttccccaggctttgttgagccaaggccttgaactggggaccacaagtgcctccttggtgctctgtctcactgtggccaagctggtatctaaggtgcaagcaaagtctcctttactttatcttctgcttttcttaagcagaaggagtctctctccagagtcaccacagctgggaatatgctgggtcttatctgaagtcagcacatctcagagtctcacctaagacccatggtgtactgcctgggtattattgctgcagttattcaggacccaagctctcttcagtcagcaagtgatgaatcctgccaggactaggtcactcccttcgaggcaagaagttcccttctggcccagggtttgtctagaaatgtcatccaagagctaaggccttgaatgggagctttgtagctctgccccctgagtggccatcaagaagcaagacaatagtcttctttattcttccctttcctcttctcaggctgaaggaaggggtctcttttggagccatcagttgtattgcctggggttggccatagcagttgtgcatgcactcttttagctgccttctgggtgtctcagttattgcctgccccccaagctcgctggctccaagccaaggtcagtaattggaattttagtccttgtgtcctagactgtgtttcaagtttatttagagtcctagagcatttcagtctatggtggccaggcttactggaactcaagttctgagtgctgggatgggtgattctcctctggctagggcgggtctgaataccccctccattggtgggggtcagctgagttcagcccagttttgtcttctgctgtgatagggcagcactgagtttaatgcaaggtctcacaatcactgcactgtacctctcccaagtgcagtgatgccacgtgaccgctgcaggggcagggtgggtgatgggaggggttggcattgacaattcaagactgtcttttctaccctcttctgtggttctttgaacaatatgaagttaaaaccaggtactgtgagtgctcacctgattttggttctcatgaaggtgcttttttgtgtagatagttgttgagtttggtgctcctgcagtgaggatgattggtggggccatcttgctctcccccctctgtatatctttattatgttctttagtattgaattcaaataacaaacccagtaataggcttaattaaatcatatttgcattcaatatcatctgccaaggaatatgtcagttgttaactcagaatgaaactgatttttcataattcttactagggatatttcctcacttttcagttttaagttagtatttttttttttttttttgagatggagtttcactcttcttacccaggctggagtgcagtggcacaatctcggctcactgcaaccctctgcctcccgggttcaagcaattctgctgccccagcctcccgattagctgggattacaggcgtggcccaccacgcccggctaaatttttttttttttttttcattagagacgaggtttctccatgttggccaggctgctcaaactcccaaccacaggtgatctgcccgcctcagccttccaaagtgctgggattacaggcgtgagccaccgtgcctggctttgctagtatttttaatacaaaggatactttttgtttattcttattatttctggcttcatattttatgaaagtaaatcaagataactataaacaatagtcatttaaatagaatactttaaaaatacattatcttttataatcttccttagagagaatgacaggattaggaagaaaatgatatctagaaccaggtttaagccatgtctgacactgccagtatgatcttgaaatctgaggctcatgttctttaactaaataataagaaaataccaactatataaatgtacagagttgttactaaggttaaatgaggcaatgtaagtaaacctgcactgaaaaatttaaaggttattcaaatgttaattatttttattgttttatgtattcatttctttcccttggagcaaatagagaaaattaaagggatataaagtggaagaaaaatgtaaaaggcaacctttaggaagaaatcatcatgatccaattgcaattgtatagatagttttgccacttaccaagaatagactcttgctatatcagtggttttattcccaaggaatctcacagtgttgaaaactaatttataaaataattgttccaatatggaaaaaaattgggagatggagaatttcatcctctaagtgatggaagtattttttcttcaagaattttaatactgaagtttttttattagcacaattgcatagttctaaattctacacattactgaacaaatcgagcattgataatgcacatcagcatctgctcaaaaatgtcttttattttcctaaaaccactgacacagagattaacacagtgctgcttataaattctttttcacacatttttatgataaataaaacacaaagcactcaagataaattttatttttacccagaagttctaactttttgttttaattgcattttaactagtacttatgagatagatgcaattaagttcttattaattgataatgttacattaaataaatatctattttttaatgttttaatgtagaagaattgcatgaattgtaaaataatcatagttttctaacatattagaaagaagaaagctatgaggagaattttaacaaatagtaggtttggctttgcctggcatgagtgtgggtagttgtggaaaggtacataaagaagatatataatgtaatgttgtatgaacagacatcaaagtacaatttacttgctttgagcaaattgtcatgaagcttaaaagcaatgtggaggaacttactagcaagtggaactatcttaagaaaaaaggtgaaataataattccttcaataaaaatctattgagcacgttctaaatgccagacactcttcatagtacagaacttaatacagaccatcttcattctgtgtttattccagtgggaggtaactgacaatacaaagaggaaaatacgtaatgtattggaacatgattagtgttatgaatgagttcagggatgagtcctgacaagagtagaggtggataattcagttgtatttagaaatactctgagaaagcctcaatgagaagttgacatttgagcagaaacatgaaggaggagagggggcatgcaatgcagatatctggagaaagaatatttgaagcagacaaaattggaaatgcaaaaatcccaagtcgagagtttgcttggtatatgagagggatggaaagaaggccaacatgatgactaaatggaaatggaaaagtgggaaagctttagatgcagtcggagagatagtttggcccattgtaaaacctcagccatttttacttggagtctgatggaatctagcgacaaacctgacttccattgcctggcatagtacagtattgagcaaaggtgtaaacagagggaatatttaagagagtactacattaatccaggtaaacagtgaggattgaactaggcttgtaatagtagcaggatgaaaagtggtaatattcccttgatgctaccttcaaaatatgtccagaatacacagggctttcacagaacccaaaggtagagtttcaccttgatggcaatagatacctagaaccaagatcttgaacatttcttctacagaaaagtaactgaatccctgaatagcttttgcttgtttgtttgtttgtttgtttgagacggagtctcacccttgttgcccaggctggagtgcaatgacgtgatctcggctcaccgcaacctctgcctcctgggttcaagcgattctcctgcctcagcctcccaagtagcagctgagactacaggtgcgtgccaccatgcccagctaatttttgtatttttagtagagatggggtttcaccatgttggccaggatagtctcgatctcttgacctcgtgatccacccgccttggcctcccaaaatagtttttataaaacagaaggatttaaagacttcaattgaataattgagtaaaaatatgcaggaaacttcgaagaaacatttttatcatatttggagttaattggagataaaagatattcataaaataatgtatagaattcgctttaaaaactgcagttttaaaacattagatataagtaccatttaaatatgattatgactttaaagaattatcttgaaggtattattttaaatggctgtctaatttttgctctcttaaagaagagtctaaatgtagatcttctactcagtataaataaaaggaaaacatggttaaatgccctctaaaataaggaattcagagtatcaactgaaattaaggctgttgaagcagaaataacttgataaatgtttaatggaagccaaatgtaaggattgatccaggaaggcatagcaacaagtcttggcacgacccagagttggctacaagttggaagggttttattaaagtttaagagaagaaacaggactccttatattggagttgtccttttacactgaaggtgcaatatagagtttataatcattcactacagattgcaacatataggctaaaatgtctacatacaagataatcagtaaaatttcatgatgcaaaaaatcaaatcagcatcgtttttaatgtcaggatttcatacattaatcagtatgtcaaaaactggagtaactccgataagattatttactaacaaacaggatgtcaccatgaatcacaagacatttcccaggagggctaatttggaagcttgccagatatgatctgtaggttatcagtagttaatgtaaaggatttattttttgtatgaagagtgagacatgtaaatagaaaacggtataaaagagttcaaagaaggaagcacgaagtgaaaacttaaatttctgaattgcttgtctgcaaatagaagccaagatacacatgagactgcccaggaaatgcatatagaaaaaaaaatacccaagccatgattactatatttcctgcaaatattagaaaagttagtgtggagaaaaactgaaactattcattatattttaagcatgaattggttgtttgcagaaatcatgaataaatatattctataaacatattttccatgtattttggaaaatacatattatatatttttatcaccttttactcaattatgactttgtatcatttctgaaagtagtttcaccaaaataagcctaatacgttactgtgtgttgtcttgtattattttctcacctattattggcatactccagttttaactttagataaaacaatatatcatggcatttcatgctttcacctgtacaatgactaagataaatagttggatgtgtcaaaaagtaactccggaggtggtgtgagcctgaaatttacatatttttgttatatattaaagaatatataatttaaaacaatacctataatttaatcacatatttgataatgtaaagatgaatctgtaccaattaaaacttagaattttttagcaaagaaacctaccccttattccacctggactaaaaaagaaggaaggaatgggaatgagggaggagtgtgtgtttgactctcaggcagtccatattttatgtactagggaatggggaaggaagttaggatataattttgcagaatagtgcacttcaactaacaatattgtttgcagctccactcctattttttattgattttatttgctgtaaacaagtatcgagggtctttggggttccacaaagcagatgggccaccatctctgctgcagctgcctctcctaatcctgctctgggctttgaatttctccactctgcaatctgtctatgctcttctattcactttcttcccccagaaacgtgctgcacactcatcaactgataacgtcctcccttacctccttgatgtttttatcattatttttatatttctatcatcattttaaagagtcattttgagaggagagtgatgaacagatctatgtctgcaggttgaatcaaaagcatctattcctttttaaaaatatattttcttaagttatgaatacacaataactgcacatatatacagtatgcaacttaatacatttgacatgtgtacacatctgtgaaaccatagttacaattgagatagtatataatatacaaataacagctccatctcctcacaaagattccttgtgcatctctacaatttcaaattttatttctttattagaaatatggccctgcaaattatctgtcttcttgggtgagactcagaagtttgtcaataattctgtccatttcattgaatttattggcataaagttgttcaaaatattcactggttaatattttgatatccaaatagtctgtaaagctgtcacctccctcactcctagtgttagtaattgtgtttttactactgtatgtcttctcagtgtggctacaggtttttcaaaattattgatcttcaaaaaaccaacttatgctttcattaaaatctgttgatttctgaggttttttccttgatttctactctgatacttaacactctgtttattttgcttaatttagatttaatttttcttctttttctagggttacaggtgaaagctgaggtccttgattcttagaactttcttctttctaatataggcattttgtggtatatttttccttttcatgtgtaaattggtttacgtggtatttattttttctcaacttttatttcagattcaggggatacatgtgcaggttttttccatgagtacattgtgtgttactagcgtttgttgtacacatgattttgtcacccaggtagtgagcatagtatctgataggtagttttttgaccttcaccctgctcctaacatctcacttgaagtatgccccagtgtctacttttcccatctttgtgttcatgtgtactcaatatttagttcccatttataaatgagaactgtggtatttggatttctgatcctatgttagttcacttaggataatggccttcacctatatccatgttactgcaaaggacatgatctcattcttttttatggctgcatagtattccatggtgtatatataccatattttctttatccagtttaccattgatgggtatttaggttgattccatgtctttgctactgtaaacagcactgtgatagacatatgtgtgcatgtctttatggtagaattatttatattcctttgggtatatatctaataatggaattactgggttgaatgataattctgttttagtttctttcagatattaccaaaccattttacacaatagctgaaataattacattcccaccaacagggtgcaagaattcccttttctccacaacctttccagcatttgttattttttgactttttaatgatagccattctgactgatacgagatggtatctcatcgtggttttgatttgcatttctctaatagctggtgatgttgagcattttttcatatgtttgctgcctgaatgtatgtcttcttttgagaagtgtctgttcatgtcttctgcccatttttaaatggggttgtttgcttttgcttgttgaattgtttaagtacctaatagtttctggatattagaactttgtctgaagcatagtttgcaagtattttctcccatttagtaggttttctgcctattcagctgataatttctttctttctttgtcctgtgcagaacctctttggtttaattaggttacacttatgtatttttgttttgttacaattgcttttggagactttgacatgaaatttttgctaagtcctatgttcagaatgtcatttcctagttttttctagggttcttacaatttagggtcttacatttaagtctttaattgattttgagttgatttttgaatatggtgaaagggcagggtccagttttagtctaacttacatggctagacagttatcccagcaccatttattgaatagtgagtcttttccctactgcttatttttgttgactttgtcaaagaacagatggttgtaggtgcacagctttatgtctgggctttctagtctcttttgtaggtatatgtgtctgtttttatatcagtaccatgctgttttggttgctgtaggcttgtagtttgaaatcaggtagtgtgataccttcagctttgttttcttttgtttgtttgtttgtttgtttttgcgctgtttgttttttttttttttttttgctaatgatggctatattattttcccacatttgtattgttttaccactttctttggattgagtttcagactcctcttgtatctcgatgagttttcttgccatccagattctgaattctatgtctgttgttccagccatttcagtctggtttaggatcattgctggggagctaatgtggtcatctagaggtaagaagacactctggcttttagagttgccagaattcttgtactagttctttttcatctgtatgggctgatagtcctttaatctttgaagttgctgtcctttaggtagggctttttgcttttgtattctatgatactcttgaggatttgattgtggtacatgttgggtttagttgattggtttcatttctggatgctttcagggggacaaagctcagttcagcattgctgggctgtatgctctaaccctgggggcactaggaccaggcctatcactttgttctgtggcactttggggtcaaacacctgctacactagagagcctggggcattcccagttcactggcgacaacactccaataagggctgccagcaaagcactgcagtagaatggcagggagtgccatacacgtgtgcactgcagcagaggtaatgggtctgtgctcaccactggggtggcgggggccacagatgattgtggccaatggggtgacagaaggggctgcacgcatgtgctcacgggttggctgttgggggtagtgtgcaccagtgggagaatgctgcaggcaggtttgtgccagcagggattcatctgcaaaagtgctctgataggaatgtaataggcagtgagcaaaagagctagcaccatggctgacggcaaactttttagtggggcagctgaggctgggtggcaaatgggtttggccaggcaggaccttggaagacaccagcagacagaggaccattcagatcagactgaccgcatgggaaagacagccctgctctctgcaggcccagctgctaataaacgctaaagccacctagaggaggagtatggcaagccttagttgtggacacccatgacagtgctcctctccagcctttcccacgccaaaccctctgggcttcatgcagactggagttctatcttgtccatctctcctggcagttttccctgccaactctaatgtccatgggggtcatggggtctcctgcagctaggatcctggaggtctatggctagagtgggctgctccatgcttatttcactcaccctttccctagaagccactgggggccaggaaggagtctggtgcttggcaacctaacttcctcccctttcagcctccgggtctacatcctccctatatccactcccaacacctgctttctgaagatctattcagagtctgctggtgtacttgatggcatggtctctctcagtgggagaagctcttcctggctgtgtctgtcagccatcttggctatttccttgtatattttcttatagctactattttagttgcatctccaagttttaatatgttgcattttcattttaatttattttaaagtattttaaaattatcttttgagttttttatttgacttctggattttcataaatatgttattttccgaatatatttgggaaattttcagagaactttgttactgatttctaaattaattatattgtggtctaaggatatactttgtatgatttttacaaatatactgaggtttgtcttatggtatataatacagtattgataaatgttccacatacaatcaaaaagaatgtatattctgctcttttttgaggtgattgttttataaatatcaatgagattaaattcaagccttctataaccttactgtttttctatttttctatcaattcttgaaaaatgatgttgaaatttgactacacttgcatattttttccgtttctctctgcagttttattagtatttacttcttcgcgtagtaattttttattgggtgccagttattttaattttaccttggtggctgctgaacatgtttatatcatcatacatagtgtgaactttgttccaaaattagttaagtttattggaaacacactgatactttcaaatcttgcttttagatattgttaggcaggatcagcacagcatttagtctatggcacatttttttcctaatgcataggtaaaactcatatgtggtctatcctatttcctgtgaattataaggtttctactctgctttttagaaacaagaactattcccaggtctgtgtgagctccagatattgttccctctaatctttttaggtgcttcagtttccggtccatgatagtttcttcacatgtgagcaatgataaatactcattaataattcaacagattctttttgaaaatctctggtgctctctctccctctctgcatttttctcctctacaataattttctctgggaactctgacccacgtaagttcctttgactgtctcctcagttatgtctcctcaattaaggaaactgtctggattccctcgtcccattctttatcatagaaattttctctcttctgtatactagagaaatcatagtttttaactttatttgttcctcgtttccaaggtttactgtttgtctttgcctgatgttcaatatctgcaaaacaattattttgcatatgttgtctcttttttagatgtttccagcaggtatttaaatctatacttgttaatccatatttaacagaaacctacgccaaaatgtatttattctaattttaatttttttctatagtaatttggattgacatataattaaatacctatttgatattcttacttggcgtatctcattttccatatctaaagctgaactcttgttcattctactaaagtttttcttctgcagccttcctcatctcaataaattctgcataatatttataatttcataaaccagtaaactggcagtcttcaaagatttcttctctctttagccaatctaatcaagcaccaaaaatatttcttgaccatctcctgaatttacaaccatcattccagctccattctctaccctattcctagttattatccttttccatatctacttcaaacttctccaaagttaaaagaaacaataaacaaacaaacaacaaaaataaatgagagaattcttctaaagacagttgtatacactgctgggagaaactaaatataagcagctctttatatcttattttaatcaatgaaccacaatataatgtacctacttataatttattaaaaatttaattcctattttaaatttctttttgaattcttattttaacttatttatttaaataaaaattcccattttaaatttattattgaaatatatagtgtaagtaattttttaaaaatggtttgagggactactacaaacgcatgcatatggcaagattgttaaaatggaaacaaggaagcaaaagttatggacaaaaggaagggagatatactaaccaccttagctgacctagctgatctgtcgtagcattaaatttagcttagagatttttgggcatcccaaaagcaatagaagtggattaattatcattgatttgataaatcaattcttcaagtatcaatttttcctaccaagaagaaaatattgaagtacataattgacaatattatgcaacatatttgtttttctcttttactcagtatctaaggcattttccctatattgccattttaaaaatcaatctccaaaaaggcaacatttttatattgaaaaattaaaagatttatatagctatatctcaatatatatctgcacatatctatctatatgccaaatattaaaacatagctatataaatatttaaattatgtatatatttattcctatatctatctacctatctatccatctgatccatgtgatttttttgtctttgctatgcagatattttcccataaatgatggaagaataagagtttttgaagtttatgtttgtaaattaccatggttctaactttatatgaggatagagcatatcttaaaatatatgctaaagagggaataatatatttcatatatccttctctttttttttttttggctagcattttgacagtaactaaatattgtcaccagtttaagacaccaaacataacagattattttggactggaaaaatttcaaaccagcattatcagtcagcaatcctgacaaagaaagcccctcaagtcatcattgtttgtaatagcaatgacaccagtgttaactcctatggaaggacaaattgcttgcctaactttgaattgcactgcctttttcttgacccttaagttcactaaatatattccaaactaattttaataacctgatctggagttgctaattacataattcattataatatctctctaactgatttcagcacattggttttacaataccctaatccatcctcctctctgtagccagactgaactttcaaaatgtaaatctgcccagtaattcctcttaataaaatccttggatgactttatttttcctaatgacaatgtctaaaattcttaacaaggtttataatgccttctaggattttgccctgcctatcatcttagcttcaatatatgtccaatttcctcattgctctctctgctccaaccacactgaactttcattcccaagtgtttcttgaatacttgattctggatctttgtacaaggaattttttattcctgaaacactgatatatcctctctttccccactgccaacttattcttcagatgtcagttcatacaccacgatctctgggaaacatttgcgaatgtctctgctcccctagactagattacgtctctccactactttccatgacacatagtactctgccttttatatctctttcacatgcataagttgtgtttaatgtatgacttcccttttgaattttaaattgtgtgaggcaaggacaaggtctgtctctatctttgttatatgccagtgtttggattattacctgaaaattaaccattgcacaaaactatttgctgaataaataaatgaaggaggctcggtgcggtggttcacaccagcaatcccagcactttcagaggccaaggtgtgtggatcacctgaggtcacgagttcgagaccagcctggccaacatggcgaaaccccatctctactaaaaatacaaaaattaggtgtggtagcaggtgcctgtaatcccagctacttgggagaccgaggtaagagaatcacctgaactagggaggtggaggttgcagtgagccgagattatgccactacaagatcacgatgatcatgccactgcactccagcctgggcaacagagagactccatctcaaaaaaaaaaaaaaataaaaataaaaaataagtaaataaataaatgaaggaatgaacagacagtaaagcgtctttttttttttttttttggttgatttaaaacatctaacatgtaggtagaagctattgtttgacttctgaacctgacatgtagttattgtaaacttttgagcacaagaaaaagataaatagtgtgattatatgaagaataattaagatttccaacagaatggtgttcgtttttttttcacagagaaatgcagcttatcaacttttttgtgtgtagtagaagcagcttcttcaaatgtctaagtacaaaagatgtagaaaaccttcaataaaattagttcaaagcatctgtgtatttcagtaatctgtgattattgtgtttatggctgctgagtgtgttcaggaagtgagattacaggtgacttttgaagtgttttgagaacttacttatacccttttttgtgtggctattgttaaccactcagatcttatgaaccgagtttgtgatggatgctaaggaagtgctctttgatgaagtaccttgcctaaggattttcataattttcaagtttggcatcggaactataaacatgtagataaaataagcgtgttttatgacccaacccccctttaaaaactgtgcagttggcagacaagcctattattttcttcaattttcttctgctgaaatgaaaggaaatatgctactatagtattctggtgggtataccatgtcctttaattcctctctctctacaagaaaaaagcccagctatcctccccaaacaacaaaaggaagcatgtaaaaaaattagtaatctattttctaattataagaggttttttaagcttgaaaagaagagttaaatttgttggcattaacctttcaattttcaatggtgtataggaatagcagagagaaccaaaagcgtgctgtgcctctgatgtgtgcactccgcgaatgaccaaacccaatttctggaaaaactgataatgatcagcatttgtcatatgaatctggatgatcaaataaaatcaattgttattctgttcattcatccttgactgattagggaattcaaatggaaagtcagacagaaggtgatgtgcatattaatgattaattattcaagaaatacttcaagtacacactgtattccaggaaaagaattttacagtaggttgcttgaaaacatgcaggaaaaagggatacatagaaaaaaatgatatttgagaagaaagtcacatttttaacagttttaaataatttcataacagccacaatgctgcttctaaaactattaagaaggtccaagagcttgcctgtgtgcatcctttaattaaaatgaacttttcaggtggatttttctatcccattaatctgtggctcatagaacatttggtcaaatgtcacatacttgctaaggtccagggattttagctgtacaatttctgaatatgttcatgtacccccaaacatatgctatcaaatttcagcaagttttttggatccttgaggaactcacatggctgggtgtgcaggatacattttctagggacatatatatccaaacgtaggagactcccagttgttctgttcccagctgatgacctaaattttcatttctaccattatttttccaggttgtaaatctgagctgattcctccatgccatctgattcaagctcataattttaccattctctgtgtgccttattccatattcttttttgtccattactaccctctttcgctccgagttcaatgtcttatatatttttaatccagcttcattaatgggtctattttcttactgtttcttttgtgtaataacttgatcttaactcagaggtagacttaccctgaaggtaatgacgcttaagctttaggcttgccatttaatttgcatgtgtcactttgaaggcccttaaagaggctctagaaatatattcacatgcttgtaagtttctgtaatatttgtaagagtaagacattttcactatagtcatgtgtttttcctttgcctgctgtgttagtcaggattctccagaggtacagaaccaataggaggtacatatgtagatatagatacatgtacctatatctaaatagatatagatacatgtacgtatatctatttagatataggtacatgtatctatatctatttagatatagatatagatacatatatgtgtatctgtatgaaagatatatatatgtatctaatgaaagctaattctccttaataaactctgttatagtttattaaggagaattagctttcactattatacagcaaagccctaccatgtgccatctgtaagctggggaaagaaaaagccagtagtggctcagtccaaatctgaaaacctcaaaaccaggaaagccaacagtgtagacttcagtctatagcagaaggcccaagagtccccaggaagatgctggtgcaagtcccagagtccaaaggccaaagactgggaatctgaggttcaagggcaggagaagtggaaggaagcatcaggcatgcaaagacagagagaactaggggaatcagcaagcaaaattatccccattcttccaccagctttgttctagctgcactggcagcagataggatggtgcccacccaaattgagggtgggtcttcctctcccattccaccaactcaaatgtcagtcttctctggtaacaccttcagagacacccccagaaacaatacattgccagccatctaggcattgctcgatgcagtcaagttgacacctaatattaaccatcacacctgtcaactttttttcttatactcagttttcatggcacctggtgttggagttgggttgagcattttaaggatccagtttagggaaagttaaattagagatacatttcatttgagtctagtgggatataaattttagttcttagtcattgctgtatgtgcaattattgttagctgtgctagtgtagaaatgcctatcaagaaacaccccgactgcccactgtgtggacccagcagcatcttgacacgaagtaacagggcttatagctacctggcaccagaagcgtttgggcacagaagtggcatatacttttaaaagtggagagagaatcaaaatctgtggaaaacctttctaaatctcctagcgcatatatgaaagaaattcagatagagattttcctaaatttgacaagaattctaaaaatttatataacattaccaataattggttgtgaatctaaaggaaatatttctatgttattgagaataattttaaaaaatatatcaaccaagctagagggaagagtctgttctatcaaaatgataaaaaattgttgtcatacaaaggggtgaaaatatttttaagttcaatttaaaaagtaagaaaaataagtagaatggagtgacatagacaactaattcataaaattataatttttttctagatttgatgatgttttaaaattatccagcttttcaaactttgtgatttgttgtactttcttctttttctaaataattattcacatttgcaccaaatttgtaatttataaatttgtattctttttaatttattgtatgtcagatccaataaacctggaacatctcctgccctaactcaattagccccaataactcaaaataagtggaaatcactataataaaaatttgatttaatgtaggggctaaagtggatggaaatctacgctctggaatgagactccctgagataaaaattcttgctccacaacttattattctgtgaccttgggcaagttactcagcatatctaaacctcagctttctcatttaaaaaggagactggattagaaagcgtaattccttgatgctctttataactgtgtgatagtaacatgaaacatagtgagtaaccaactaattaaaattagtatgcatgttgaaaaccttggattccctgtaatttcacatcagccctatggattcctaattgttctttcaggtatgtgtagagtaagaagaagtctagtgtggcaactgacctacctgtccattcttttaactagcatagtcccgcttttattaacttcatttacactctaagctttagtttgaacaaggtgctctgtgtctgtatatgtgtgttcatatgtgtatttgaatacaactgcccttgcccaatccttctatcacaagaatcatgtgataacattagtgaaaatattacaaacagaaaataagtggtaatcgcttctctatttgacttcaatcttatatgtaggaaggatggaaggatatgtttttatttaaaataaaacaaaataaccacagaaaattcttccttctagatcagagattaagcattcaatgaaaatagaaaattaacaagaagtgattgagagaaacataagcttccccaaattctcagggatattaaaggattatcaagtttcccatagcatatgggactgagcctcatgttaatatttggttatttatatttgaccaatattaaaagaatgtgtaaactcaaacagcaggaggacttggataaagagctaacactggcattttatgtatagctccccaaagacttgctttattgatttagtatttttaattgtactttttaattagaaaaaaatcacattttaataattgctactcataattgccagacagaataatcttagtccgtctttaatttgacagcttttcaaatgaatgaatcagtttcatccccaaataaattcacttccaattaaaagttgattgttttatgacaggacatagagatattttctttgattcttacatgtcattgagaagtaacaataatcagcatctctgaaatttcctttcacttatagagacccaagccttctggcaattttccatgaatgaagtctttcttgtaatcaagatattcctgttttattaatttttttcttttatatttgtctgcgtaagaacagggaactgtcttaacagaatttctaatacctaggtggtcagatattccttcaaattaaacaaatttgatgtcttaaaactaagtgtaacaaataaataaataaataaagagaatgttcagctcctttgctaagctatacccagtaatttagaataagagtttaacggataaaataaaataagcaatagttactatttcatgtatatcctagtgcaggggtccctaaccctgggccatagactgatacagtgtctcctaaggaacagggccacacagcaggaggtgaataccagcaagggagggaagctgagctccgcctcctgtcaagtcggcaaattagattttcatgggagcatgagccttattgtgaactgcttacataagggatctaggctatgtgtgccttatgagaatctaatgattaatgcgcttgaatcatcacaaaaaatggtctccactaaaccagtccctagtaccaaaatggttggggaacaatggcctagtgtacagttctcttgttttgaaagaagaagaaaccaggcaatagaaataactggtgcgataaattgacacttgaaaagcaggtagttaaggggaacaatgtttaagaaggcagtgagttttgaatcattaagacttgtaaagctgagtgtctaaagtgaacattttaattatggcatgtttcagttgtaaaaatagatcattaagaatcacttataatcttggccctaggataggtattttggatatattcttaattatgtaaccaaatgcctaataatatgtcaccagtattgtagatttctgttgccacctaaaattctgcattatatgcctgattctacaataaactaaccaatatcccctttggaaaatataaggctttaaccatttctttattactgaatacttatttttaatttttaatattttgactaatgttaatatgtgtatctttctacatagaatattttaattccattttaaatgagtaaattgtatgtttcccctccttattctgtagttcactaatttatcctgagggactggagttatttgatttacattcaggttttgtgtatgtgtgttttgtgtgcatatgtatgtatgtgcatttgcaacatgatttgttcttcatgtagtgtctttttttgttgttttttgttttgtttgtttgtttgttttgttgagacagagtctcgccctgtcatccaggctggagtgcaatggctcaatctcgactcactgcaacctccgcctcctgggttcaagcaattctcttgcctcagcctcccgagtagctgggattacaggcgccttccaccacacccaactaattttttatatttttagtagagacagggtttcaccacgttggctgggctggtttcgaactcctgacctcatgatccacccacctcagcatcccaaagtcctgggattacaggcatgagccaccatgcccggcccgtttagtattttttagtgttttaatttctttgagaaaattgatttttttttttttttttttctgagatggagtctcactctgtcacacaggctggagggcagtggcacaatcttggctgtctgcaacctccacctcccaggttcgagtgattcttctgcctcagcctcccaaataactgggattacaggtgcatgccatcacacctggctaattttgtagttttagtagagacagggtttcaccatgttggccaggctggtcttgaactcctgacctcaagtgatccacccaccttggcctcccaaagtgctgggattacaggcgtaagtcaccatgcccagctgaatattgactttttgatcctcagtttaaatattgttttttttttttttttaatttttatttttgagacagagtcttgctctgttgcccaggctagagtgcaatggtgcaatctcggctcactgcgacctctgcctcttggattccagcaattctcctgccttagcctcctgagtagctgggactacaggtatgcaccaccacacctgctaatttttgtattgttagtggcgacagggtttcaccatgttggccacactggtctcgaactcctgacctcaagtgatctgcctgctttggcctcccaaagtgctgggattacaggcatgagctaccacgcccgacttaaatattgcttcttatagcatacttcttcactgatttcttcccttgcttgtacctgagagttctgatttactgttgtttttttggcacgcatcctacccaagttaatggctttttttatgtgttctgtaatataaattgattatgttacttcagaattttgagcatattcaaatcagttattcccctacccactgccacaggacataatcaatccttttgaacacttatactccctcacaggtagaaaaatttggggtggagtaactctggaagactaagcatctttactaagagcctaagcccttaagaaaggccatgtaaatcagctaggagggggaactaaactttgtgttagtctcaacatttaaattgaacagaaattgtttgtatcagaagatatgatatttttaagagacaagagcaaagattttttggttttgttttgggttactcttcaactgagcagattagagattgttagaaagattagataagttgcagaaaaatgcaaaagctccctttcctttgtacatctgagtaaatgtgagtaattagtattaggggtatagaaaccttaagagagtcctaagcaatttttcatggcctcacagatgttcactaaagtagtcaaagtctcttcttatcagcaagaagtgtgaagaattgcctgagagtgaaaagtcaacagatttgcaagagctttagaacaccaaggtcatgagtacctacaactgggaacactgagcaattcagtggatgtcagcacagatgccaaaggctatacatgataattacagctcagcagatgccaccccacatggatactaatgatcagaagccagataccacttggtatgactataagcccctaggtttgaggtgatcactgggagaggaaagagaagaaacgacaacctgaaattattttgtttcccactgaaatgcctgaaatctctggaatacactaaaattttgcttttggccgtcagctggaattgggtctagaaatagatagaaaggtgaattaatgaaaatataaagggaatagtattttttatacaccactgtatgtggtctgataactcataataaggataatttggccgtcagctggaattgggtctagaaatagatagaaaggtgaattaatgaaaatataaagggaatagtattttttatacaccactgtatgtggtctggataactcataataaggataattttaataatgacacaattgaagaaagagctactgttagtaataccttggggactgcagtttatgaaacacctctcaatgtatgactttttgctaatctagttttattcactgaagtatttcctacagtgagagtgtgccaggaagcactggtaagaaaggaatgggtacaatgtgtgtaaacggtgtgcctgacaatttagaagactagaggttaagagagatgtgaaagccaaatttagagaagtgaaagccaatttttcatacctgaatgtttttatttatcctcccaaggatgatacacacaggggtgtatgttagactcaagaggtttaatttcagagttgcagagttgctgctgatcatttaccagagtgtagcctgggaaagccttaagaccagggccaaataagttaatacaaacaagggagaaaggtggtaacaggaggtgaaatgggtgtttctagcacttctgtttctccatggcccaaatcaggcattctaaatacgttcttggatactcatgtagaaagtcagaaggaaggtgaaaaatagaaattgatcaggaatgatatttccagaaaaagattatagtagttatataaaataatattttttatttttgagttagaatatgtaaattacaagcccattcattcatcaaaatgataaagagctgtaacttttgagtgactttaatcttttctgttagtcaatagtgtttatcagatatttttattgtccctccctcaggtttcatgtgcacttccctaaccccttgtcattaggtgcttgagatacaggttgacctttatctgtgggagaaaattgtaggtattgctgtagatcggagagattcaagagtcaatgttgagtgcaggactttgagaatggtggagtgaaaacctctgtgaaactgttcctttatgaaagcaatgaaatgctagaaaaaattgtcaaaataaaatttttcaaaacctggaaattagtcaaatgtttgcaacaatatacatttattcaacaaaagtagcagagcctaggtaagaaaagcagaacatttttatattgacttgttttaatcttcctttttccaattatgtgatagccttgaatcatagcagctatgaaagccagcaggcttgcagccactggaggagacagctggtgaggaactcctcacaaagctccactctgagagcataccacaatgtgacttatctaccagctccatggaaaaaccccattcacagggcgttgttgttatttgaccctgggaaggagagaaaagcttatttccagagttcccctattatattattcgaaatgtttagttttcaacaaaaattatgatacatgcaaagaaatagcaaaggtatcccatatatggaaacaaaaaaaagcagttaacagcaaacaatatcccgaggacattcaaatgctgaacttagcagacaaagattttaaatcaactattatgattagaaacaagtaagtaaaggaaaccatgtccaaagagttcaagaaaagcatgacaacacacaacttttgccaatcagcagaagtttttatagaaatatttgaagcatttacagaaatatttgaacaattattagatgacaagtgagataaattagtggatatttctgtggctatacactgcagggaatatggactttacagaattagaggaaagtatgactgtattaggccagtcttgcattgccataaataaatacctgagactggataatttataaagaaaaggggtttaattggctcacagttctgcaggctttacaggaagcctggtgcgggcatctgctcagcttctagggaagcctcaggaaggttacaatcatcttgcaaggtgaaagggcaataggcatgtcacagggtgaaagcaggagcaagcgaaaatgtagagggggaggtgccccacactcttaaatgaccagatctcatgtgaactcagaaggaaagctcccttaccactgagagcatggcccaagccatttgtgaggaatccactcccaggatccaaacacctcgcggggatgacatttcaacatgagatttgggcagggacaaatatccaaactacatcaatggcaatggtgtctcaacacgtacagaatgagagaaagtgccacaaaattaaaaagcgacaaacagagattctggaattgaaaagtaagtaactaaaattaaaacaaaaaactactagtggagttcaacaacagatttgagttgccaaaaggaaggttcagtaagctcgaagatacatcagttaagattatctagtcagaagaatagaaagaaaaacaacacaaatttggaggtaagtatacactcttgcagccattaccaaaatctatgctatgtacatatccatcacctgcaatagtttcttcttatgttctttattattatttttttgtgataagaacacttcacataaaatctgccctcttagccaatgtttaaagtacacaatactgtattgttaactgtaggcactatgctgtacagtagattgctagaatttcttcatcttccgtaactgaaaatttgtaccttttgacaaataactttctgtttccttctcctcacaagattcccctcattttagagcaggggttttacacaccaaattgtcaacaatgagtatttcttggtgaagatttggtgggtgttcagtcagtaggtgtaccttccattttaactttacatatacctgtattgttttatttttaaaaataattaatgtaaataacacttataacaaaaatgaccaagatgaaaactagtggctctcagatgctgttaactttggagagacactctgatcatagattttggtaatggttgcacgagtgtatacttacctccaaattcatcaagttgtctaccttaaatatgtacagctttttgtatgtcagtcatatcccaataaaatggtttttaaaataaaaaaaataaaaacaatacaaaatgtgaatacagcctcagagacctgtgggctaccatccattgtaccagcacaaagataatgggaatcccagatgaataggagagaaaaaagagcagagaatatttaaagcaagaatggctcaaaacctcccaacctgagggaaactgttaatctactcacagaagaaatcagtgaactccgagtagtagaaacacaaaaagctccatacctaaaaacatcacagtcagtgttcaaattagaagaaacatagaatactgaaagcagcaagagaaaataactcatgctgtgaaatgaatgctcacaaaaatggaacgaattttcataacatacttgaagtgctaaaagaaataaatgaaatagagaataaaaaatgaataagaaaaaacaattagttctttaaaaagatcaacaaaatagaaaaatttacctaggctgactaagaaaaaagcaaagagaagactcaaatgactaaaatgagtaatgaaatggaggacatctctaattatcctgcagaaataaaaaagattatacaggaatcctgtaataaaccgtatgctaacaatgatgtaacctagaattaaaggaaacatttctagaaataaacaaattaccaaaattgactcaagaataaaaatgaactccaaagtaacctataacaaagattaaattgccaagtaaagaacacttctcacaaagcaaatgccagtcctagatggtttcactggtaatttctgccaaactcttaaggaactaaaaacaattcttcacaaaatctttcaaaaaatagaaaagggagaaacacatcccaactcgttctatgaagctagcctgataccaaaaccaaataaagggatcagaagaaaacaaaactacaagccaatgtcccttatgaatattgatgcaaatattctcaacaaaatagtagcaaactaaatccagaaacatataaaaaacattccatcaggaccaaatggaatttattccagtaatgcagggtcgctctaacatctaataatcaacaaatgtaatataccatattattagaataaaaaaaccacatgattttctttataaatatgaaaaaactgacaaaatccaacacccattcatgatgaaaaaaagtactcaacataataagaacagaagagaacttccttaatctaataaacagcatcagtggaaaactcacagctaacttgaagaaagactgaatgatttctgttgaatagcaggaaaatacaaagatatctactctggccacttatatgtaacattatagtgaatgttctagttaagacagtcattcatgagaaagaagtaaaagtcatcagaatggaaaaggaaactaaaactatctctgtttgcaaatgatatgattttgcatatagaaaatccaaaagaatctagtggattcaatttaaataataaacacattcagcagtgtttcaggatacaagatcaatatacaaatatcaaatctacacaccatcaatgaaaaatccaaaaatgaaatgcggaaaacaaaaccatttagaataccctcaaagacataaaatacttagaaatgaatttaagaaaaatgtacaagacttgtacactaataaaactgttgaaggtaaagacggtccaagtaaatgaaaagatatgttcagaggttgaaaaacttaatttttaaaaaaaattatttattttttgagatgcagtctcattctgtcgcccaggctggagtgcagtgacacaatcttggctcactgtctcccaggttcaagccattctcctgcctcagcctcctgagtaactgggtttacaggagcctgccaccacacctagctagtttttgtatttttaatagagaaaggggaaaaaacttaatattggtaacagacatccaacatagtttgtttgatagaagttcagcatttaaaatacaaaatagacatcattttgaaaatgtaataacaaatatatgtaggcaaatatataagccaagagaagctggaatacgcaaacccagtagctgacaagataaaattgaaggaaaattttcagaaggaatgaagatagactttatgtactggtaaaagcaacgattattttcatcagataacatcagtttaaaatatgttaacacagtaactgactgaattctggggagcaatagataagtccataatagcaatattaatccaaatacctcagaaatatatagaccaaattgatagaaaacatacaatacaaggaaagatacagaagattagaataataaccagtaataaattataatatggatcatggttaaaaacattgtcaggaacttagaagagctggagagagagaacgtggagcagcaagtatcagaatagctgataaaacaacaagcccaaatgcaagtaatagtcaagtctttaatcacttactgtgaaggaataagcaagaatctcaaactggaggtagcactgacctcatgttacatccacctgccccatgagcgtatgcaccaattacgggtcgggtagattagtactaacataatggctgtctgactgttgagggagctctgaggaaagacttttgcagttttatagacctgggggttggggtgaggtctggggcaaggctagaagtggaaaatgcctgagtactgaatgagtccgaatgcagaaagtgttttcaagatcctccaacaaggagaattccaaatagaaggcctcgactaggaatgcagatgagcatgagagcatggctggccaggaagctgagttcttgactgcaattcctgtcagagactgcagtgcactggctgtgtagccagtctggtgtggggagggcaactttcccccatgaggcctgccagctaaagccattataattgcttgtggttgtacctgaaaaatcacaaaaaatttttgaccatgggctgaaactctcaaacatacaattcaaggccaaactgaaccctgccacttagttctgtcactgactagacatgagatcttgagtaagttatttaacaattctgtgcatgagtttttctattcgttgaatgggaatacgcttggtaaaggaagtatactgatataatatattttatctacagaaagaatatcagacacatagtgttataaatttgttagcacttgtttatatgcatacataggcacaaacacacatgtatccatgcatatctatattatgaatatatctgatgtacatacatactattatacatttttattgtatatgtgtttatatatgtacacacttacacaaacaaatgatttttgtacctaacaaatgcacatacacattctttcagatttaaatgaaatatttacaaaatttggccatttgatatgctgcactttatctctgtgtcagttcacttcccattggctagaattcagtcacatggtgacaacagaatgattctgaaatgcattctagctgtgtaactagagatagaaggaacccatttttgaacagttagcatctcttctgtagtttgcctctttctagttaccaactactatgcataccctttttcaacacatatattaactctttcaccaaaagaaaaaacagaaagtttcactagttacgcatttcaaagtccagaattttagaggacataccctcctccccatcaagaatgaatatgtatatttctggtctgctaacataaaaaccagaaatatgattatttgttgctatccccttacacgatacacaatagcagagccaggaataggctattacaataaaaactcacactaagaaaaaaggaagaaatggaaacacattacagtcattgattcagagcaacattgctgttttgctgggctagtattgtaaaatcctccaccctaacagtactggaagttttaaaaattagaccttagatctgttttttgggaggaacacctggctccactacctgggaggttttgtcttatcttttgacctgttggacaaatgtaagaacactggagatcatgttccctttgaaggatgaggagtgtggcacaatttcttttggtttgcaagttcaatgagtcaaaactttttttggagcataatattaggtatttcagtggtacagatgcttcaaaaacataacagaatttgtatctatttgttttcagtatcttctatgaggcagcagccaaagccaaggttatgttgtagacattgtttttaagttgtttctaatttctgtgcttattccttgtgcccatctctctcttaatggaggctactttaaggccttctgaaaaggtaggcttggatgggaaggccaaactatttcatcagacctttgccatagggttaagcacctttatttaactgagaagactttcaagtcttttcttgctacatgggatgaggaagtactgggctttttataaccatgtcccacttttctagagcctctctattccctttcatttatacttgaaaactgatcaaacttgaatcagttaataatacattgctacaaacaagcagaactaagcaaacaaaacagaataactttctggctctttccagctactttctatgaagtagcaagttttctaggcacttgatctgccttacaaatgattgcaggcaactaataaatgtattaccactaaaataaacaaaaaaagaaaaacctctgtctttacagcctgtgatattatttccttgccacctcctgtttggctgctaagtcaatggcacatattttaggttttggttatgatatcatgccatttctaatacgaattatttcttattgcatctgaagaacaaatttgtaaatgacattaggtagggagcaagttttctcaaaactatttctcaggactgtatactaagctagtatttttaaacttttttttttttgctacaacccaaaacaaaaaacacaatttatatcattctataaacacacacagacataaacctgtatgcatacacatggataccagatgggccaacactatgtcatatctaaactgggactattactgtcaaacccatatgtgtggtatgggtatctgaaattccctttatgatgctaaattggtttttcacatgaaattttaaaaatttgcttgaaaactgctgagcattttgtatttttagtagagacagggtttcaccatgttggccaggatagtcttgatctcctgacctcgtgatccacccgcctcggcctcccaaagtgctaggattacaggcgtgagccaccacgcctggccaactgctgagtattttgaaatggtatttatgacagctaggttagtcctttgagacatcagattgataggaattttatatcctgatttagtgttacatttattgaagagttttaatgattaaaaataaataataaataccatgtattatatgataatcatgtttcatttaaaagtacatacgtatcttttcacttaacgatttatacccttaagtgttaaagtatatttccatttgatctaactttaatagtacttaaaagaattaagaataaacagtggaaacaacattaatctttttaatatctaaaagaggtctttattactattataataactactgataagagatgcaactttacaataggagtactgagttttctatttaaaaagaagttttctatttaaaaagaaattttctatttaaaaaggcattgtgtaatttcctaaagtttgaagtattgtgaaagcgcatcttaatgtcggaagggtaacaaatcctaaagttgattagtaagaaaaaatagaatagcatcacagttcttttttaaaaacccttaactaaacagaaaatacaaatttggaaacttaaaaattaaggatctgtttgtttctttgcatttatgccatggtctctgaatttgtatttttttttttttttgaggcccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacaggtaatagactaatgtgggataaatttggcgagataaaatgcaggccactgtttcgagttctttatcattataatgcttataatttcacttaacaatttcagttgacatggtaaaaatgtactatttgggtgtgtttcatttgtaagtttataagtagtgaaatgaataacatctcacattttagtacttagagtttaagatatatacttgtgtttctctgcctggagcatgactcagaattacccagtgatcacattgagacccatattgtcgggtttaaacatcagaatttctggttcagtaggtataggatgaggcctcaatttcatttataatacctcaggtgatgccaccagtgcagggaccacacttgtggaaccaatatctgagatacacatttagtaacaatatagtgttgattttcataggtaaaacagcagatagtcaacatgattatttgactaagtcagatactaacccagatatagggaaaaaagcctctctagatagattttcatttcccaattttagcttttggtcccttcatgaaggatttagtggatatattaatagacttgttatattttaattacgggggctaggcatataatttaatacattctttatgtcagaagcatccctttttgttcctcagaaaaataaatgaaggaagatattgctattattattctccacagatgaggaccccgaggcacaaatatcacacagagcattcttgcttagaatcgagtttcaaacacacttcagcctaattctaacttgttctctgtgtattatgtcactgttagtacaaactggtttatcaagatcatgacatttaaaacttaactggaattttaaagaatatgtgtctattgaaaaaatttacatatttccagagttttccctccatggtcttctttcataattagttccatttaatctgtgatcaagcaatgaaaaataaatcaaaggaattttaaaggggataaaataattttgaaagggaataaaggacaaacattcaacattgctttgctattagattgaggatagtaattaaaacttaatttgttttataaatcactgaaaacatatttgtaacagtaaaaaatatgggaacaatctaaatgtccttgaatagaagattggctatacatattttgatatatctattatatagaattctagacagtgattaaaaagaatgaactagatttatatatattgatatggaaacattaaagagtaaatagaataattgcaaattatattaataacacatttatgaaaaaatctaaatttatgcacatagacacacacacacacacacacacataaacatatatctttttaaactatacaagtgggtccagaaggacatttcaaaaatacatatttttaaaaattgttgccttagtgtaggggagtgaaattgaggggtgataaagggctaaaattaactctttcttctacatatatttgagttggttttattctctcacaatgtgtttatttatttgttaatatttgtaattatacatttatttttttcaaacattttctaaaattaaaattagaaacaaacatttaatttgatggcaccttaactcacgtgattgacgattaaaatatgaattttcaatctttcacaagtgtcaggtattccaacttgcatttcaatagggtgtactttcaacacttaaaaattaggagactctgtgtttacacctacctgtgtcaaaatccctctcaagtttttaaagcatttagttccgacagctcagatctgtttcactaccaaagaagtcaactcattaaatatatgacctttgtagatttctttgttcatccagtttagtaaaaaggcccaactaggtgtctgtctctctcctttttctttattcatgtatgtgtttccctccctctgctattatttaaactattccttctagtagcccctcatcaccaggctgctgactttcaatctgctgctggggcttccatttctctggtgcaattccacacagctgtttgtaccttctggtctcttttctggccactagttcttaaagcctcattatttaataaagcttcctaaacttaccattattcactaagcctcttgatcattcaggttttataaataatcgaacagtaataggaaaacaatattatatttctaagtagtgaataaaacacattatgtgtgtctaagttaaaatgctacaaaaaatgattactatattattatattatttactgactatattaatattactatatatgagtacttatattaaaattactgtatgtaatgtattttacatatagtcatctctctatatacatgtgtacgtagatataatttactgaagtcaaatggaaggatttttcattagatcacatttttatggcctgaacaagggacatttttatgattgataacctaaagctcatgaaaactaaaagaattgccagtttagttactaacctgtaacaatatcccagatcaaacttttattatctagctttatgttaatattaaaacccatttctataaaataatgtttttctcttttatatctatgtcaccttgactgttttctttgtgtagtcctttgtcttacagtattatttctcttctatttctttcactttatttcattctgtaacccacttttatgagattgtatctcaaaaactccgtaattcctcattttcattaaattgtatatttacttttaatgctgaaaatatttttatattactaaggttctaacatttctttaacctgcatagattttattttctgttgtggtttatattttatttaacaactaaaaatatggtagctaaatctcatgaaatatgtagtgggcatcttttctagacatcaattaaccataattcaaataatttattcttataatagaagaaataaaatctttagctgagatttagtataaatccagtctttatgtagactcatcaagaaaaaaaggagatccaagagaaacccaggaaaggaaggcttcactgctgaattttaccaaatattttaaaaagaattaatatcaattattctgacactcttccaaaaattgaataggagggtatattcccagactaattttatgaggccagcattaccctgacactaaaggcagacaagttaaatgaattcagtaaaattgcaggatacaaaatcaacatacaaaaattagtagtgtttctctactaataaaatattcaaaaaggaaaataagcaaacaattccatttatgaataacaataaaaaattacttaggtgtaaatctaatcaaggaagtgaaagacctgtaaactgtaaactagaaaatattgataaaagaaattgagaaaaatagtaataaatagaaagctgtgctttctatgctcatgggttgaaaaaattaatattgttaaaatgctcatactagtcaaattgatctatagattcagtgcattccctatcaaaattccaggacatttttcacagaaatagaaaaacaattcttaaattcatatggaaccacaaaagaacccaaatggccaaaacaattctgagcaaaaagaacaaagctagaggcatcacactctctgatttcaaaatacactgaaaagtgattataataaaaacacaaggcaatggcataaaaacagatatgttgatatgataaggctttgtgtccccacccaaatcttatcttgaattgcattgcccataatcttcccaaatccccacgtgttcagggagaaaccaggtggaggtaactaaatcatgagggcagtcacccccatgcagttctcatgatactgagtgagttctcatgggatctgatggttttataaggtgctcttcccactttacttgagttttgacaaaggtgctaaaaacactcaacagagaaaggacagtctctttaatgaatggtgttggagataaatggtgtttgaatttatgagtgacgacttacagtatctgtagaagaaatttctaagcaacaaagtgatcaagatatggtctggctatttctaacatcctatgttcagataagggagcaaagaaatgacttaaagttggaagttctctttaaagggaaagcagagcatgagagttttgaaaatttgcagcctacccatataacagcaacaacaagaacaaaaaagctattatgggtggaagaatccaagaaggctgtggagcaaccacttgttagaaatatttgtgtgactaaaaaagagctaggtgctgatagccaagacagtgggaaaaaggcttcaaaggcatttcagagatctcctaggtagacactcctatgataggcccagaggctaaggatgaaacaatggttttgtgggcctggcacagaaccctgctgccctgcatagcctcaggatgctgctccttacatgccagccactccagctgcaactcaaaggggcccatatatagcttgggatgcccctctggagggtacaagccataagctttggtggtttccatgtagtgttaagcctgtgggcatgtagactgcaacagtgaagaaggcttggcagcctctgccaagatttcaatgggtgtatgagaaaacctagatgcccaggcagaagcctgctacaggagtagagccctcacagagaacctctactagggttatgcaaaagggaaatgtgggattgaaggtcctacacagagtcctcactaaggcactacctagttggacctgtgggaagggcactactgttctctagaccccagcatgttagatctactggcagcttgcactctgcacctggaaaagctgcagctactcaactcctacccctgagagcaacctcaggggccataccctgcagagacatgggggcagagctattcaaggccttgggagcccaccacttgtaccagtgtgctccagatttgggacacagagtcaaaggaagttaattttgagttttaagacttaagccttgctgggcttcagatttgcttgaggcctatagcctctttcttttggtcaatttatcccttttggaatgggaatgtttttccattgcctgtttccccattgtatcttggaagtaaatagtactttttgattttataggctcataggtgggaggaacatggattcaaactcagataagaccttggacttgggacttttgagttaatgatggagcaagttaagacttttggggactgttgagatgggataattttattttggaatgtgagaagaatatgagatttgggggccaggggcagaatgatataatttggacatcccctccaaatctcatgttgagatataatccctagtgttggagatgtggccttgtgcaaggtttctggttcttgggggtgggtcccttgtgacttggtactgtcctcatgatagtgagtgagttctcacaagatctggttgtttaaatgtgtatggcacctccccttattctctctcctgctccttctctctccatgtgatgcgtctgcttccattttaccttctactatgagtaaaatctccttgaggcttcctcagaagctgagcagataccagcacctgccatgctcatgcagcctgcagagccatgagccaattaaacctcttttctttataaatgacccagtctcatgtgtttctttatagcaatgcatgaatgacctaacacatgctatattatagaaactcatataacttagatataatgaacaagttcagatacaaactatcataattgactcaaaggaaggataacttgaagaaggataactaaaataaattaatgtattaaattggtaacttaatattctcacaaagaaaatccctgacccacatggattaataatgaagtctatctagtacttaaaggagaatttagagcacaagcaatgaacagttaagaataaaaattaatttataaaaatgaaattaagaaattcagttcaatttgccaataacatcaaaaatataacctgcttaggaataaattgtacaaatgaagtgcaagacttgtacattgaaaactataaaacattgttgaaagaaattaaatagaaagtaatccaatattcattgatctacataattaatattgataagatagcaatactatttatattgatctacagattcaacacaatccctaacagaaataccaattgtcttttttttgcagaagttaataaattgatcctaaaattcatatagaaatttaggagatgcaaaacagccacaatatattgaaaacaaatgataaagttgaaggactcacacttctctatttcaaaacttactacaaacctatagtaacataaaagtgtgatattggcataaatatatagagagatcaatggaacagattgagtccagaaataatgttttaacttgatggtctattggttttagacaaggttactaagacaattcagtggtggaaagaaaactcttttcaacaaattatgcttggagacctaaatatcaagatgctaaataatgaaggtagacccctaatttacaacatacacaaaaaattaccaaacatgaatcaaggatataaaggtaataattaaaactataaaacttttagaagaaaaacttaagaatcttcataatcacaggttaagccatgtgtttttacacataacactgacagtacaagagacaaagaaaaaattgaataatttggaccttataaaaattaaaatattttgagcttcaaagaatagaatcaataaggcaaaaatgcagcccttgaaatggaacacagtacttgcaaatcatatatctaataagggtctcatgtccagaatatgaataacttgtaaacctgagtaacaagaagacaattaacccaatttcgaaaatgagtatattagctgaatagatacattttcagagaagatataaaaatagccaataagcacataaaaatgtccaacattattgtcattaagcaattccaaataaaaattacaatggcatactactccatccccactaacatgattaaaatataaaagaaagtattaagcgttggtatggatgtagagaagttggaactcatacatttgtcttgggattgtaagatgaagccactttgtaaaacactttggcaattcctcaaatattaaccataatgttacatttgccccatgtattagtctgttctcacactcctaataaagacatacctgagactggataatttataaaggaaagaagtttaatggactcacagttccacatggttggggaagcctcaaaatcatggtggagagtgaaggggaagcaagacacatcttacatggtggcagacaagagagaatgagacccaagtgaaaggagaaacccgttatgaaaccatcagatctcatgagacttattcactaccatgacaacagtatgggagaaacaaccccatgattcaaatatctcacactgagtccctcccacaacacatgggaattatgggagctacaattcaagatacaatttaggtggggacacagtcaaaccataccatttcactcctggcccctcccaaatctcatgtcctcacttttcaaaaccaatcatgtcttcccaacaatctcccaaagtcttaactcatttcagcattaacgcaaaagtccacagtccaaagtctcatctgagacaaggcaagtcccgtccacctgtgagcctgtaaaatcaaaagcaaatttcttacttcctagatacaatcagggtacaggcattaggtaaatacagctgttccaaatgggagaaattggccaaaaccaaggggctaaaggccccatgcaagtccaaaatgcagctgggcagtcaaatcttaaagcttcagaatgatctcctttaactctatgtctcacatccaggtcacactgatacaagaggtgggttcccatatcttgggcagctccacccctgtggctttgcaggatcccagctactttcatgggctagtgttgagtgtctgcagttgttcttttctgtcacatcatcagaatgcaaattttttgaattgttatgctctgttttccttttaaaactgaatgcttttaacagcacccaagtcacctcttgaatgctttgctgataccctaaatcatcttcctcaagctcaaagttccacagtcctctagggcgggggcaaaatgctgccagtctctgctaaaacatagcaagagtcaccttttctccagttcccaacaagttatttatctccatctgagaccaccttagcctggattttattgtccatatcactctcagcattttggttccaaacttttccacattttcctgtcttcttctgagccctccaaactgttctaatctctacctgttacccagtttcaaaatcttttccacattttcgggtatctttacaacagcaccccactctaccagtatcaatttactttattagtctgttcttaagctgctaataaagacatgtctgagactgggtaatttataaaagaaagagatttaataaacttatggttccatgtgactagcgaggcctcacaatcatggcagagggcaaagttgaagcaagacacatcacacatggcagcaggcaacagagaatgagagccaagcgaaaatggaaaccccttctaaaaccgtcagctcttgtgagacttactgccatgagaacagtatgggggaaactgcccccatgattcagttatctcccacctggtccctcccacaacacttgggaattatgggagctacaattcaagatgagatttgggtgaggacacagttaaaccatatcaccccagaattccactcctaaatacacatctaagaaatgaaaatatacattaatgccaaacttatatacaaatgtttatagcagtattattcacagtagccattatgtggaaaaagaccaaatttacatcaatgagtgaagaaacttttaaaaaatatgtgcatatcattataatagaaaattttggggtgaaaaaagtgatgaactactaatacatgccaaaacttgtgtagaccttgaaaccattatgataaagaagccagtcacaaaaggccacgtgtttatgactgcttttatatgaaatctccagaataggccaattcatttggacatcaagtaacatagtggttgccacctttgggatatgaggtaagggacattattgctgatgcataaggtgggcggatcacgaggtcaggagatcgagatcatcctggctaacatggtgaaaccctgtccctactaaaaaaatacaaaaaattagctgggcatggtggcgggtgcctgtagtcccagctactccagaggctgaggcaggagaatggtgtgaacccgggaggcggagcttgcagtaagccgagatggcgccactgcactccagcctgggcgacagagtgagactccttctcaaaaaaaaaaaaaaaaagagtttcttttgggaatgataaaagtattctaacgttagattgtgacgagattcaatgtatctttacatatagtaaaattcaacggaattgtacattttaaaagggtgaatttcattgaattgtatctttaagccttttaaaaaattgggataatgttaatcttttagagtgtacaattcagtgacatttagcacattaaaaatattttggaaccatcacagcatccagttcccccaaaatttctatcatcctaaaatggaagcccatgcccattaagcaatcactcaccattcccctaaaccctggtagccactagcctgttctctatttctatggttttatttattctgaacattttgcatgaatggaatcatacaatatgtgaccttttgtgttgagttctttcgcttaacatagtgttttcgtggtttatctgcattgcattatgtacttcattgtacctcatgagctgttaattgtttctttaatagctgaataatatcctcttatgtaagctatttttaaaatgctttttaaaaatcaattggagaccaatggacaccaataatgcaagccagctcctagagagccctgtgattgaaatcaatttcttttaataaatttgtttaatatgaaaagagaaatacaaaagaaattttaaaaatccactagaaatgggttagctgagacaaactctttctgtgaaatgatttaaacaaagttaagtaaaatgaaaaattagcatatcagagacatcagtatgccaccatacattgaatatatcatacacgtacactacacaacttcagaaatataatttacctgtgttttcccactcccctcagaaagcacctttgcataacatactgtgtggaattctgtcatatgagaaagaaatttatttcttatagattttctataatctcttatattagagtaacagtattttatgatgtgtacattccttttactaccattaatcctttgatagacaatcctcttagctgtgcaggataaagctcactgtccctttcttatgtttgaggactctgagtttcaaaatcttactagttctacaccagtgaagggtagaagcaagccttttgagtctgggtcttctgaagccaacctttagctttgttttacccttttccatgaattacatttttccatgaataaaattaagctatagtatcaaggaaacttgtttgttaacatgtatcatcaaagagccttcactagaataatatgtggcattaattgatacaggttttgatgggtaatctaaaatatctttgctgaaatactggcttatagaaatcagtgccattgcttttacgatcttttctagtgtgagaacagtcttgcatggtgatgctaattctctccctgttatctgttatcaggagaatggctcttgatgtaatatgtcctttttatggcactggcctgaatttaatgttcaatgtaaattttaatcttttaaatgtctgcaaaataaactcttttttatgaaagtgacaccaataagagagtgaagatgatttttaatggcaaaggaaaataataaatatgtgtttattttaaaacttagagcattgaaaaatgtgattatatggcacattataaatagaccaaaagtcaaaagaagatgtaaaataaacttctaataagatgtattggctaaaaatcttgtgttttatgggaaaatgaatcaaatcgtcactcagttttgtacccataaggggatacagttttatccccaagtaattggagatttagtaaaattgacacatttaggattaaaatgtggtatgacttaatattagaatcagaatgaggatttcagaaaaatattgtgagtcattatgtacttcaatcaaaatctaatctagacaacaaacatggaaaaaataagattgcataacaattattggtgaattttaaggtagatattttttattaagctttttttttttttttaaatagccacagggactgttaaatgttaatgtctgaagttaaaataactttttcactggagagaaaaaagtttgactttaatagccaactattcatgatatttattatcagaaagaatgactgaagaaaccaattctaaagctcatattattgtttttgtagattattctcaagattgactggcttatactagaaatcttgaaaagccaattcatctggttatccagggatatattttaaaatccgtaaaaagtggagaaaccatctggactttatatttattgagaattggtatttaaacaaattttaaaagacctttctgagatttttgtttgttttagtagaagggcgtttcatagcaaattttaaaagcttgatggtatataacttggagtcagaaaaaacaccttcttttggtggtataggtgctttgatttatttttagaggtaaaaaattcttagctcttccacccgaatacctatgggtgtaagaaccataatactttcttcaggcatgtgggggcttcttcaatatcccaaagctatttgttcctccccactcctggcagggctgactctaacacacacatgctcttgatctgaaacataatttaatctgcagtggttagacataatagttactcaaaaaatagttgataggtgaatctatgcattaactagcattggaggtaatttccaacaatgtaaactttaatacgcagtactgatctaaagttcattcaggaacaaaatatttattgctagatgataatctgaaatagatgtagttcatgcattcttccagataaactaatgattatcattcaattataatgctgaattctatggccacatatcacggtgccattcttttgaccttcccatgtaaaagtgatttttaaattcttagaaatagtctattatgcctggtaaagggtattctattaattacttttgtgaaaatcttagttatgtttatactaaagtgtaaacttttgggagaaatatattcaatgttattgagaatttttatagttactaaatcctgtaactgatcatatttcctcttatatgttggctattagaaagcctttaaaaactatttgattttaaatagatatgatattgttttgatataaattttaaaagattgaaatgttttaaaagtaaggaaaatggagctaaaattgtccctgtatccagcattacctccttgaaaatatatagaatttcacagaatatgttttgtaatttaatattattcttgccttcatcagtttttcctatgtttatcttcactgtatttcattaactttttaaacaatattatctgtatttttgtatgctcacaagataaatccttttagataacaaatgaaatcctttactgaaaaaagtcaaaggctttgattttaatatgtgttgttatgcataataagaaactgttttccttctctggaaatttttaatgtaaacaaaatatttgaagaaattataaaaaataacaatctgtatatatttttaaatctgacttcaaattgatacatgaggcttagacatacgtgtgtcatttgataactgtcttaaatatctaaatataaatcaaaaagcattttcattacttcgactataaaaacacaaattcagtaagtacttcaaatcttggaagaataacttgaaaactacaataagtattataaaaggtaaggatgaatgtgactgaacttgaagaaaatgtgggacataaatgaaaacagactctcatcagcacataggtcctctacatgtggacgtgattacacagagatgtgtaaagtcttactgataacagtgtggtcttgaaatacttaaatacccttcaagacaaattataccttcagcttaaccacaaatcaatgaatacatcctaatgacaggatgtctaaagaccatatatatgtatatatagccagaatatatatgcatatatatagccagaatactcctatagtaactctaagtacacagtgatgatcagcaagtgataaaatactaaatacagacttggagcttagctgaacagttggatggacaagtcatgaacaactgaaattcgtaattaaataagaaacacagtttctaaactgttcaatatttattgttcatgcttactgtttggaatcaggcatatctacattagttttgaaccaaacaatgttaaaatagtcacatgcttatacaatcacttacgggaataataagagttaactatattttgggtacccttcacatacttcttaatattttgactcattagtatcttaatagatgtccattcactagttcatatattttacaagtctaaaaaattcatattattatactaaaaaataataggcaataaaaaagtttaattatcataaattcctataaactttgggattaaacttttaaagttaagcaaaataacatttttgaaaatgttttagtgattttttaaaggattaataattaataggttgttacaatcatttgtgtattataaaattataaattattcctttatgcaatcgccaataatatttaactattttttaaagtaacttaatgctatgaatatgatgaattcacttaatgctatgaatatgatgaattctcatttccgtgtttattccctctgcaattggcttcattgagagggtcgattttaaaagtttgcaatgttcgtagtttgccttaccaatagtcctctgaccagtcacctcaagccaggatgatttagtgatatccttttagggagagcaagtccagaagaagaccagcatctgacaaaggtcctttatgaacaatttgattcattcttgtctctgcaacttcactttctttctgtcccttacaagagttctcctggaacctcccctaactgtccaagtttttttttttttttttcatttttttgatgagagctttaattcattgctgtgattcaactttaatgtatatgcttctgattttcaaattcataggtttttagaccttacctcagctcaacattcacataattgaactgctaatatttctgcaaacaccacttttgaataactgcatatttttgtcatacagatatgttatacttgatcaatctttttaaaaaggttgtacatattttcctatcatgaatactgtggtcctgaatatatacttacagtaacttttacttgtattttggattatttatttatgacagatttctaaagttaaaagtaatgaatcaaaatgtgggtatattttaatatctcgatagttgtctacaaatgatcagaaatatatcatcccagtgttacatgagaatgccactattgctgcattctaaattttaaggctttggtaatttaaatgttgaaaaatcaccctctccccatatttgagagtcactcctgactgtggctgtcctggccaagcaggctgccccttttctttctccatccttatttttggtgtttcttgtcacttttctgttaaactccagtgttctctcttggataatgtatttgaggtatggttttctcatacattattttggttcttataagtggataagttgtctatgagatgcttctagtcagccatcttaaaccagtcatacttcattttaaaaattagcactgtttttattctaattgaacattgtgtaattggttatttaaaacataattccaatttccagtgctctcctaagtgtgtcctaacctgcttttaagtgaattctttaaaatactttttcctgtactgtgcttctgacaaactgggtaattcactgttctttatcaaccttcctagcttgattgaagtccatcaagtactccatgttacctgcttctggtcttgttcatttgatttcctactatacaaatatttttccttccatatctgtcaatcaaaattgtatctacatttcaagatccatcataaatgcttctttttcataaagtcattccatatatttcccaccagacacaatttatttcttctccagaccttcatatcattttatgtactcatttaaggatgtttgccttgtattgcctcttataattatatactttgtaattttcacaataccagaagagtatttatttttattttggaacagagagtatcaatatttgaaggctatttcaatagacgctctgagctcaaaataaaatgaaataaatttctttacatcccgtccagttagctgtgtaatatttacgtatttgcttttttaatctcaaaataaatatccagttttatttgcctgctgtcttctacaagttattgcattattctaagcgaggttattagacttgtgtcttaaaataactactcctggtaccttagaagaggaaaaattggacctatgcaaaataatcccatttccaaagattctttaatataataaaagctatgaaaaggccattttattgctttgttatcttatctctgcaatcatttagaccttataaagagattccataaattaatccatctggcttaaaatttatataactttcttatatttttcctaggcttccatctaagggcctgagaagaaaattgaccatcatagagttttatcttattcctcaatagacagaattctaaggaaaaaaaaagagttgatcttcaaatattttataaaattctttggagagaaatactgtaggggatcattaattaagctttcatttattcgacgagtgtttttgctaaatgcctaaaattatctaggctgtgtgatatgagctggagatacagagagcagtcagtttcttctctcaagaggttacagtctactggcagagactgaaaacaaagagtgccatggcaaaaattctgtgaagaaagatcccagaggaggcctgttaattaggttggatgggggcagggctgaggtcagaaaaggcttccctggtagatagataacagttaaactcaattttatagggcaaggagggattcaccactgacaatatgaccttattcatccaattatagttccttgaaacttttaagtccttctagaatggctgattttagctgaaggtctttgtaccagagagtgggaaatgtttagcaagattcacaatcatgtttgctttaatcagactttgtaattggccgttaacctttcaaaaagtcactatcaaaatgattaattaaactttctctaactagtatttttaattctttttaatgccttctgttcattaatagaagtatagttaagagctattttcaaatatggggtcctgcattaggggtttcacaagtcctcatgagaatggttctttgatttttcatgtaatagaaactaggtatataaatacttttatgaaacttattcctaaccaacttgattttgataaattacttttgcaaagtctgggaatcattatttaatgggctggaaatcagtattgtttccttattgtctgatttttcttttttttttttttcaacaaaccacttttattataaaaatttccagacttacataaaaacccctgtgaccccatcaaccagtttcaatagccatcaagtttgccatacgtatttaatctatcctccctttacctccccacctttttgctttttggctgaagtttttttttttaatttttatttatttatttatttattttttattatttaagttttagggtacatgtgcacattgtgcaggttagttacatacgtatacatgtgccatgctggtgtgctgcacccactaactcatcatctagcattaggtatatctcccaatgctatccctcgcccctcccccgaccccacaacagttcccagagtgtggtgttccccttcctgtgtccatgtgatctcattgttcaattcccacctatgagtgagaatatgcagtgtttggttttttgttcttgcgatagtttactgagaatgatggtttccaatgtcatccatgtccctacaaaggacatgaactcatccttttttatggctacatagtgttccatggtgtatatgtgccacattttcttaatccagtctatcattgttggacatttgggttggttccaagtctttgctattgtgaataatgccgcaataaacatacgtgtgcatgtgtctttatagcagcatgattcatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacattctctccagcacctgttgcttcctgactttttaatgatcgccattctaactggtgtgagatggtatctcattgtggttttgatttgcatttctctgatggccagtgacggtgagcattttttcatgtgttttttggctgcataaatgtcttcttttgagaagtgtctgttcatgtccttcacccactttttgatggggttgtttgtttttttcttgtaaatttgtttgagttcattgtagattctggatattacccctttgtcagatgggtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggcgtaaggaagggatccagtttcagctttctacatatggctagccagttttcccagcaccatttattaaatagggaatcctttccccattgcttgtttttctcaggtttgtcaaagatcagatagttgtagatgtgcggtgttatttctgagggctctgttctgttccattgatctatatctctgtttaggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctctattatttcattgagcagtggtttgtaattctccttgaagaggtccttcacatcccttgtaagttggattcctgggtattttattctctttgaagcaattgtgaatgggagttcactcgtgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagctcttattattttgaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgtatcccagggatgaagcccacttgatcatggtggataagctttttgaggtgctgctggattcggtttgccagtatgttattgaggatttttgcatcaatgttcatcaaggatattgatctaaaattctcttttttggttgtgtctctgctcggctttggtatcagaatgatgctggcctcataaaatgagttagggaggattccctctttttctattgattggaatagtttcagaaggaatggtaccagttcctccttgtacctctggtagaattcagctgtgaatccatctggtccaggactctttttggttggtaagctattgattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttaccattttttattgcatctgtttgattcttctctctttttttctttattagtcttgctagtggtctatcaattttgttgatcctttcaaaaaaccagctcctggattcattaattttttgaagggctttttgtgtctctatttccttcagttctgctctgattttagttatttcttgccttctgctagcttttgaatgtgtttgctcgtgcttttctagttcttttaattgtgatgttagggtgtcaattttggatctttcctgctttctcttgtgagcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttgtaatttctgttcttttgcattttctgaggagagctttacttccaactatgtggtcaattttggaataggtgtggtgtggtgctgaaaaaaatgtatattctgttgatttgggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggaatctgagtctctttgtaggtcactcagaacttgctttatgaatctgggtgctcctctattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccattggcttggtagatcttcctccatccttttattttgagcccatgtgtgtctctgcacatgagatgggtttcctgaatacagcacagtgatgggtcttgactctttatccaatttgccagtctgtgtcttttaattggagcatttagtccatttacatttaaagttaatagtgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctttcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaatgatgtgtcttggagttgctcttctcgaggagtatctttgtggcgttctctgtatttcctgaatctgaacattggcctgccttgctagattggggaaattctcctggataatatcctgcagagtgttttctaacttggttccattctccccatcactttcaggtacaccagtcagacgtagatttggtcttttcacatagtcccatatttcttggaggctttgctcatttctttttattcttttttctctaaacttcccttctcgcttcatttcattcatttcattttccatcactgataccctttcttccagttgatcgcatcggctcctgaggcttctgcattcttcccgtagttctcgagccttggttttcagctccatcagctcctttaagcacttctctgtattggttattctagttatacattcttctaaatttttttcaaagttttctacttctttgcctttggtttgaatgtcctcccatagctcagagtaatttgatcgtctgaagccttcttctctcagctcgtcaaagtccttctccgtccagctttgttccgttgctggtgatgagctgcattcctttggaggaggagaggcactctgatttttagagtttccagtttttctgttctgttttttccccatctttgtggttttatctacttttggtctttgatgatggtgatgtacagatgggtttttggtgtggatgtcctttctgtttgttagttttccttctaacacacaggaccctcagctgcaggtctgttggagtaccctgcggtgtgaggtgtcagtgtgcccctgctggggggtgcctcccagttaggctgctcgggggtcaggggtcagggacccacttgaggaggcagtccgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttcgagcttccaggctgtgttgtttacctaatcaagcctgggcaatggcgggcgcccctcctccagcctcgctgctgccttgcagtttgatctcagactgctatgctagcaatcagcgagactctgtggggtaggaccctccgagccaggtgggggatataatctcatggtgcgccgttttttaagcccgtcggaaaagcgcggtattcgggtgggagtgacccgattttcccgattttccaggtgcggtccctcacccctttctttgattaggaaagggaactccctgaccccttgtgcttcctcagtgaggcaatgcctcgccctgctttggctcgcacatggtgcgcgcacccactgacctgcgcccgctgtctggcactccctagtgagatgaacccggtacctcagatggaaatgcagaaatcacccgtcttctgcatcgctcaggctgggagctgtagaccgcagctgttcctattcggccatcttggctcctccccccgatttttcttaaatgctggttttttttttaaatacatgaaatcgttttatgtattttgaatatttgaatgaggaatccatgctatttgtttcttctcacaggttaaaaatttcaaatgcttatatttagcttgcattattaacaaatgtctcttttctcacaattcatacatttaacaccactttgtgctctgttagtaatattttaattgttctttgacaccttaattagatagtaatcttttttagacaattttatagtattttaataatttgtctataaattttgggattatgtcaaatactctttgaattctattttgagaagcttttgtaaattcagtttcagccaaattttatacttttctctgaactcttcattttaactccatttacaatgttaaattttttgtttgaataaggatcattttccttttttattctcccctagtacatctatacagaagtcaaccaaaatttcgtctcactctgcatatatgtctgaaattaaaaaaaaacttttattttcaaatttcttctcaaataattttgatagatttatgaatatgccaactatgttaatttaaggaaataattgagggtcaatttctgaactctcttacaaataatgtattagtccgttttcacgctgctgtaaaggaatacctgagactgggtaatttataaagaaaagagttttaattgcctcatggtaccacagtctgtataggagccatgatgctggcatctgcttaacttctggggaggcctcaggaaactaacaatcatggcagaaggcaaaatgggagccaagactttatatagctgagagcaggaggaacagagagaagagggaggtgccacatagttttaaacaatgggatttcatgaaaaatctatcactagaacagcatcgagaggatggtgctaaaccattcatgaatgattcacacccatgatccaatcacctcccacggaggccacatctccaacactggggattacaattcgacaggagatttgggcagcgacacagatccaaaccatatcgaatggtaagaattattttaattcccattgaggttgtttataaaatctataaaactaacatacatttgtaggtatatatttatctatatatacattttatacatacacatcactacttaaatatgcacgtacagcacacacacagagcactcatatgtatgtatgtttgtatgtgtgtgtgtgtccttcagatgttagaacacatttgaaaacttccagaaattaatgtactttgtaacttttgacaagttattttatcattctgagccttggtttcttcatctgcaatatgcagtaacaatgtatggttttctgggttattggaataattagtgttagaacacctagcacagtgcatgacaaatatttaatgcttggtacatgatatttactcttcatggcatgtttggtatatatgaataacaggaatagctgtttctagatttaagaaatctagattaagaggttgcttcttaaggagtcatttatttaggaatagccaatcaacccacttgtcattaagatctgaaaacattaacttctattttatggagaatatctagtgaaaggtatacttagagttctaatcaagaactattattttgctcaataattaacaatgtctttctttataagtatttaaaaagagacttgtttttaaagtctcaggaaacttacattcatggcagacggcgaaatgggagccagcatttcatatggctgagagctgaaggaagagagagtaggggaggtgccacataagtcattctcttatgaacaagtaactaatactaccaaatctctttctagacttgtttttgtattataatgtttatatcataaacatgtattcataggcagacatatatttacttttattttaaactttttaagtgaacatatattactttgtaatgtattttttaactgaaaatgtcacatgctaaataacacactgtagtcttattttatcataattgaaacactatctctaagcaatatatttcaagaatgagacagagaggggaggggaagaaagaattctatgtcaaattacaaagactagtatagtcatgtggaactgccactgggtgtcttcaaatactggctctaccactactagctcatcaagcttgggaaggatgtttaatttttccctgctttcagtttcctcagttgtaaagttgaagcaatcacagtgcctgactcatagggttataatatgtttagaatagtgtctctcatataataaaatgttcaaaacaaagaaagtcaaacaatatttgctgtcatcttgtgaacagatttttttctctagtttttttctccactatatttgcataagcttccatttaattgacatatcatagcatcaggatatttcacccctaaacacttcagagtgtatctaggattcaatatttgtttctgacactttattttttaaggcaaaatttatatacagtgatgtgcatatgtataccttaaatgtatcacttgatgagtttagacaaatactgtatcccagatccttagcaagatacagaactttactatcaccctaaaagttctctttatatttcttcccagtcagtctgttgtctgtcccataggggcaatggctctctatttctttttttaaattctcactatgaattgaattcacatgaatcatttaaaactttgtaatgaagtcagacagcatgtacccttttgtgaaaactttattccaatcaacataatgcttctgagatttatccatgttgtatgaatcaatagttcattccttttcatagctgagtagtattccattgcatggacatacaagagcttctttacacattttcttccagagggacacctgagatttttatagagttcagctattatgataaagctgctagtaacatccttgtacaagtcctttttggacatctactttcattcctcctgagcaaatacctaagaatgaattactgggacatacgttagatgtatgtttcattttataaaaaactgccagatatttttacagagtaattgtataatttatactcccagtaacaatgtgtgagaattctagatgtttcacatctatgccaatatttgattctttcagtttttaaacttttggctattgcagtctccctcttctgtttccaaataaatgcgcttattcaaaaattctgatttgtataagtatgggtgattcttattttttcttgtgccttttcagtaagtttaattttgtaaaagcatttttagcaataaattcagcattttacaaaattaaaaaataaatttagctaaaaaacgttatataaatacttgtcaatgttgtgtaaatgattacagtacttgtagcttgcgatataatttcagggacttctttacattaaaatgcaaatatactgtatcccaaaccaacttgagtaaagataatggtttcagggaaatgtgttggatgatgaaagaaataatctgaactatgatgaagaaactaaaagagaagagtcatgtgagatatttgaatatttatgctttttaaattaaacacagtttttccgaagtaatagtatgtaatatgaggtttttaacattattgttaactaatttaattattattattagatacagtctttttcatctacatgtttaaaatttcactaatttaaattggccaaaacttttaagataatgtttgcattggtaaaatttggttatgtatattagttttaaaattcatttaaaccctttaatagtaactacaacaacataaaattattatattcaatgaataattgacaaaataatacgtttaaaatacatgtagataacttagcatgacaatctttgatctggacgttgatcctaggagtatatgattctcccataattacacaatgaatgtaacactgggactaaaaatcagtccttctcctgccttctagactagcatttgatccatttattatacaggcactcctcagagaaatttcaggtttagtttcagagcactgcaacaaaatgaatatcacgataatgtgagtcacacagattttttggtttcccagtgcatataaaacttatgtttgcattatcgtgtagtctattaagcagtgattgcattatgtttaaaaatatatataccttaatttaaaatacttaattgctaaaaaatactaatgactacgtgaaccttcagtgaatcctaatctttttctagtggagggtcttgcctcaatgttgatggctgctggctattcaggctggagggtgctgaagatatgggtggttgcagcaaattctctctctctctctccttttagagatagtcttgttgtttttgccaaggctgaacttgaactccggggctcaagtgattctcccacctcagtctcccaagtagctgggacttcaggcacacaacaccatgcccagtttggctgtggcaatttcttaagaagatggcaatgaagttttctgcatcaattgactcttccttttacaaaagacttatctgtagcatgtaatgctgtttgatagcattttacccacaaaacatttcaaaatttgagtaagttctctcaaaccctgccaactgctttatcaactaagtttatgttacattcaaaatcttttttaaaattcagtgttcacaacctactcattagaagtagatttcatctaaagaaaccactttctttgttcatccataagaagcaactccttatttggtttaagttttaccatgtgattgcagcaattcagtcacatctgtaagtaagctctacttttaattctagttatcttgctctttccaccacatctgcagtttcctcctccaccaaagccttgaacccctcaaagtcatccttgagggttggaatcaacttttccaaactcctgttagtgttgatattttgacctcctctcatgaatcacaaatgttcttaatggcatctagaataatgaatcttttccagaatgtccagtttactttgcccagctccatcagaataattatgtctatggtagctatagacttatgaaatgtatttcttaaataataaaacttaaaagttgaaattacctcttgattgataggttgcagaatgaatgttgtgttagcaggcaggaaaacaatattcatttacttacacaattccgtcagagttcttgggtgaccagatgcattgtcaatgagcagtagtattttgaaaggagtcttttttctgagtagttgatctcaacagtgggcttcaaatattcattatagaatgctataaaaagatatgttgtcatctaggcttggttgttccatttatagagcacaggcagagtagatttagcataattgttcagggccctagaatttttgggatggtaaaggagtagtggcttcaacttaatgtcaccagctgcatgtcacagtcagctgacctgcatgtcaccatcacgagctgtatgtcatcatcaacctctcctttgaaactttgaaaccaggaattgacttcttctctcttttagctataaaagtactagatggcatcttcttacaatagaatgctgtttcatctacattgaaaatctgtttagtgtaaccacctttatcaatgacctcagctagtgttctggataacttgatgcaacttctatatcagcacttgctgtttcaccttgcactttatgttatagatatgtcttctatctttaaacctcatgaaccaaactctgctagctctcagcttttcatctggagcttcctcaccctctcttaactttcatgaaattgaacagaaatagggccttgttctggattaggtttcatttaagagaatgttgtggctggtttcatctatccagaccagtaaaactttctcagtatagcaatgaggctgttttgcttacttagtgtgttcactggaatagcacttttaaatttctacaagaactgttcctttgcattcacaacttggcttactatttggtgtaaaaggcgtagtattcagcatatttcatctttcaacgagccttccttactcaggttaatcatttctagctgttgattcaaagtaagagacacatgactcttcctttgacttgaacacttagaggatattttagagctattaattggcctaattttaacattgttgtgtttcagggagtagaaaggcctgaggacagggagagagatggggaaacagccattgaatagggcagtccaaacacacacaacatttaccaattaagttcattatcttatatgtgcatagtttgcggtgcccaaaacaattacatcaatggtaacatcaatgatcactgatcacagatcacaacagatataataataatgaaaaagtttgaaatattgtgagaattaccaaaatgtgacacagaaacacaaagtgagcacatgctgttggaaaaatggtgctgatagacttgctagatgcaaagttgcacgaatctttgatgtataaaaaatgccatatctgtgaagcactgaaaagcaaagcacagtaaaacaagatatgcttgtattgtgttgcctagaaggaggtctagtttaagctcagacatccaagcaagaacaacctttactttaaagaagcatgaaaatcactcccccatggtcactgtgtatgaattgtgactaagaaagtcacactaataagcactcagaaaaaaagcagacatggcaagcatttgatgacttttaggacattaaaaaaaatgattggccctgaaaatgcaatttgtaaagtttctaattctttcaagttcataagcaaagtgtaagaaaatatctcctgacagcacttgagtaatttgcttcaatcttatgaagtaatgtaaataagaaatggagaaagacaccatcccactcttacccccttattcttcaaaggcttcagaagaactggaattaatttaagttgcattagaaatattcacaaatgagtatgtctttcagatgtacaggcacacagtttaactttaggaattggggttggatgacagtttttagagatttatgtaagagtaggacagatatgggaaaaactcttctttctagtaataatcagccaccctctccaaactgtctccattattaagttctataagtgattgtcatcatgtccagagcaaagataaatgaaaattaagggtaggtatatattgttatttatataaaataggaaaaatggcattttgtgtatgggaggctcataaacattaaaaaacattcaagggcttttctggtcccatttttctcacaatgtctcaaatctattaataattatatgtaaccatgttttcttccactagaacccatcagttctgtgagaggatagctactatatgtaattgtctgaaaagaatactccaaatgtataaacatgcctttgttattcttgttacttgagtaaactatttgaaaatgcctattacattaaattcactgttacagaatacactgaaagaaatacgttgaaagtaccgtaagtgtaatatatatattagtcatatctatatcaaggagcctgagcacacagtatatattttttggctttgtttttttcagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatggtaagagatgagtatttgctttttccacaagcaacaaggtaacgggcttttgtaaaactttatctcttccagacattaagatccaatatctttagagtcctgaaatatttacgataatatagcctttaaaatataaatgatattattaatacttacatttgattaaacatttttgataaaggatgccttcaacagcatctgaccactggcagggtttgtgtggtgtatttggtaacagacaaggttgatgtggctggatccctgaaagaaggataatagtagtttcagataagtgagagggaataggtgatttgaggagggagagacaggaagactaattgattatgaaagacctttaaatcaagtcaagaatgtatgtttattatgtttgtctcaagagcaatgctaagatagtcaagtagttaattacattacaatcagaaattcttaattgaggaaaatcttttgcatctatataatatttcaagactattagctggtcaaaaattaaaagttccatatctttccgaatctctggatactccacatgggatagaggtctgaattgactagaattgtggctgatagtcagttctcaatttagggtgatcaagatgttcagagtagaaaagagtcaaagaaccaattaaaaccaaataatttagcattatggggtacaatcagaaaaatccagaactaatatcatattcaagagaaataagcatggatcatatccagaaagaatgacaaggataaaaatgaacaagcctataaaagtatattattcatctcacatgaatgaatgatgtttctgattgtcttcttgttagggatggaaaacaatgcatttgccatgtcagtgaccacatataatggacctaatgctattttagtctgctctagcaaatatgccacgtttagcacaacagctgtaattagggcttcaaagaccgattttttttttttaatgttcaaactcatgtattaaatggggatatgatgggaatcaccagatctgcattctgctttaggtctttaggagcagtactaatttctggcattccacctgagatgtgatatggttttcaatttcctatcttggccagagtgggggaaagggtagagagaagtttcagaggcttccacttaatctttactgtgatagctcttactgcacaggccaagaaaccaatgtggaaactctacccactaccaagtatccatttaaattttgcttttagggaccatggatattgcccatggggtaggcttatggacccagtgaagccactgggaaacagacccaaaccaaaactttactttttaggaattctgcctgtttattctctgtaacaggtgaccatgatgacattttgtgtatcaaggctttaatgtcactatctcaaattttacagctccacttctccatcagggccctagccttagcataaaataataataaaaaaatacttgcagaggttgagactgctatagcagagctccagagaagataaatatgaatatatttatatctatgtgcatatctatctctctatcatgtatgtatctgtctacctacctacctaccaattatctacctacctaccggcctatttatataccaagtcagattctcagatttttctgccctctaactgttgaaaatgagattttctttatgtgctgccaaagaaccctgggattagatcattcatcttaaatgggtgattaattttcctcttccttttattgtattcctttagtgcactgagagctcccagcagcaatcatcctatgccatggtccttataaatactcattctacaatatctcagacgtctgagatattgtaccttccagtacattcccttctactagtacctaatgcctgcttaacatcattaaaattttatcagtggtactgatacaactggtcagagactaccagtactccagtgatggatttgtattgctagctggctggcaggcagttaagctctaaatccagtattttttctagtttaataaaattttttgaaaaaatgaaaagatagaaatcaaggcagacaattttaacttgcagcaactctgtggtttttgttgttgtttaagtttgcagaaggacaagtatatgattactgataaacttatttcacattgctaaaaatttaaagtatccttgctaaccctgtcccctgtagaaattatgagtttagctggtgttatgaaacatgctgctctttccctattttaaaaatttgcctttttgtgtatttacttagtgggcctttttcaaataaaaatattactatttccaaagatttgtgtctaggagagttttgtagttttgcacacataaagggctatatttttctttctcccttttttggctttataaaaaaacattatttgcttttttattgagtttcaacagagaaccgaacaactaagaagaagaaaaaagttataacattttcactcttcaatttcaccctccaacagtttggtaaactaatgggcatcatttgagtataacaaacataaggtgaaaaacatctaatccaaggatcaaatttatttctcatgagataatgtatagttgtgaataaaaattgttaaagctccaagcatctgctgttctaactctttactacaccctggacgaaaaataagtgcagtataaatgtacagtgaaacaattttttttttgcttttctcaacatagatttacacattgaagctgaaagctttttcattagagttgattatataaggaaagagataaaaaattacacatttatttacaagatcaccaacttaatgcttctaagtagctttaaaatctttcattaattttatttttccaattagtcttacaacttttaaaattataataataaattcaaatttcttagagacatctcagcataaatatagtatggtctgtgccaaaacacacacacacacacacacacacacacacacacacacagacacaaacatgcacttctatatttcatatttatatacttctatattcaacatatattactatctgcagttaaacatattttactaaaatctatttttgctatgattaaatttagcaaaattataaaagcaaattattaagttgaagattctcaataattattaaaagaactttctagtttgttaaagtagttttctttgaaatacatttggaattatgtggaaaaaactgataaaaatatattaatatattcaacaggcagggcccagtgagggtaaattataaaatagtaatttttttttacaccaaagttttcaaacaagtggtgtagtattactcttccatgatacctggatcttagcacctcaatcagatcctaggtattaatgaataacctcactctttttggtcttacaaattccagtcctgtctttatatcaaattttcaaactttcatgcttgatactcagcttatgccttattgtgccatagaatccagcagtgggaagaatagtttaaattggtctattcccctttcttactttgcatactcttttactcactagcttggttttctggctctttccagtcaggaaaggaaggaggctgggaattaaaggcaaaatggtaatgggaccttatgtgattggatgtccaaatataggctcgttttctcagggtgtttcccctcctgcagttccctggagctggtgttgcctcctagagggctttttaataccgtacccttgatccctggcttcaggcagtgaccacttgaatcgctttttagggtcaaaattcatctctccaggaggttctccagggttgttcccttttcgtacagtttagctggatactttttgtgggtccccccagttgatgggctagggaaagtttcaagtttactccactaaattgctgtgtcctcactctgagcccagaggtcactgggagtggaggaaaaagaaaacttcaggactctaaaaattgtcatgaagcaggtatctttcaatctttgctgccaacttcctgatctcatttctcaagaggatcttgaatttacagttgaaggagtttgtactcatttgagacagtagttgaaattatggactttgaatcttatacttaaaatagcattgggcacaaaaatctgtatttggaagatttttttttttttttttttttttgaggagtctcgctctgtcgcccaggctggagtgcagtggcgcgatctcggctcactgcaagctctgcctcccgggttcacgtcattctcctgcttcagcctccccagtagctgggactacaggggcctgccaccacgcctggctaattttttttgtatttttagtagagacggggtttcaccgtgttagccaggatcgtcttgatctcctgacctcgtgatccacccgcctcggcctcccaaagtgctgggattacaggcgtgagccactgcaccccgcccatggaagatttttgaatggataacaatgaaagtgtctagcagggtgtcacatactaacgcaggaaaaataattataggttcactgctttggtctaggagtgagattacaaaggcagggaatacacagtgattaaattcttagtttgtgcctatgtaaaaaaatagtttaagtaataggatatcaatacctattaaaaaaacaaaatgatacttatttgtgatcattttggaagctataataataccatttattttcttggtaagataagaaaaggcaatggttctacctctctttgtaagtgtataagttggggaaccagagataataagcatatgtagagaatgtaaataaaaaataaaattctaagcccccagccaactgaatagacccctcgtcttagccaagaacattacaaagttaacctgaaaaactagttgaggacataattgccaggggggtcagacattcctcattataccctcttgcttttggtattcaggcacaactgaccagcattaatgttaaaacagagaccttaagactgacaaaacactctttgtagccataaaatgccaacatgacagatggcaggccctggaagatattgaagtattttaccccaaaatatatttctttgacatattttgaaatggccctgaaaagctgtctcttgtggggaaaatcaatattctatagaaaatcgccttccctttccaggtctttttcctgatacaagagaaaattagctaagaatctggcacctttttaagtctgatatgaaacatttacaatctattatgtctgaagcctgctacctggaggcttcatctgcataataagaactttggtagccacaaccctttatattaatgcagatcctttatattaattaaccctttatattaattaaccctcttctattgattcagggtctttagataatagcttaactctttcaactaattgccactcagaatgtctgtgaatccacctatgacttagaaggcccctcttcaagttgtcccacctttccagatagaaccaatgcacatcttacatgtaatgattgaggttttatgcctccttaaaatgtataacaccaagctgtagttcaaccaccttgggcacatgttcttaagacctcttgagactttgccttgtgccacagtcatttatatttggctcagaataaatcacttcaaatatctcagagtttaacttttttcatagacaataatttaattgcttatggcataaacttaattgttgatatttatattcttaatgggaataaatcccaactcaaaaatattctttattttcttgtatcaattactagctagtctgtcaataacaaaacctctgaaaaaggacagggtggagggaggaaatgtggtaaaatcaacctgctgccagtatgtatatttccttaatttacagtaaagttattttgaacaaattaatcactaaaccatcaaatcctaacttttccatttcccaaatacaaaatatttctaacctgtgttatcagcacaacctgtattattcaagctgaggataatgaagccatgagtattttatgcatactgcccagtacatctgaggttttatcagatatctagagaaaattcagaaggcattgataaatggtggatccaactaaagaaagaatatctcatttcgtaaagcagttgaatagcaatttcatcttcagatcctggataaaactcaaccaatttgtttcaaacaagaacatattccaattaattgtaagttctgcatcaagtgactattgggatatcttggaagagtaaaggcaaagtcatgtttgataaggacaaggaatttaagctatttgattttgctgcctccagatttctgataatgggtgctgcctgaccttctgagtacgccattccctgcggtcagtgctccatattcttttacttgtctcttcattatccaacattcttcacagattcattcctggtatggtcttaccctggttccctaaatcttttacctcatttattcatgggcatttttgaaagtggtgttttatagagcatatttttaatatgcaacacaactactataaaaaacaaaatgaacggcaactagaaaaataagttttcaatttaagaaacacatctaaattattcgtgacacaaaacaggagtcacaataaaaaatcaaaactatttcaattaaacaaaaatacataaatgtcacatatcaaaacaaaaataccatgaatcaaaacttgtaatatatatatgcagtgaaaaaagacacagaatgtgatttgctgtttagtattgatctatgtgtgactggagtataaagtttatgttttgtttttttaattaaaaaaaattttgtataaatttatggggaatatgagccctgaaaatttgagacaggtctcagttaatttagaaagtttattttgccaaagttaaacatgcgcacccatgaacagcctcaggtggtcctgatgatatctgcccagggtgttcagggcacaccttggttttacacattttagggagagatgagacatcaatcaacatatgtaagaagtacattggtcccatccagaaaggcggggacaacctgaagtagggagggggcttccaggtcactggtaggtgagggacaaatggctgcatttctttcgagtttctgataaacctttccaaaggtgacaatcagctatgcatctatctcaatgagcagaaggataactttgaatagaataggaggcaggttggccctgagaagttgccagcttgactttttcctttagcttagtaattctggagctccaagactttcttttcacagacccatatgcaattttgttataagtatataattgagagtgatcaagtcagggcatttagggtgtctatctcctgagtataatacatttttgtttaacaatatcgtcctccttgcttatcaaatgttgaatttatcccttttaagtaactgtatttttataccctttaacccagttctcttcatctgcccctcctccacttactcatagacatttaaatggttctttgctacttctagatgtcccctgactcatatcccaacccccagtgttaagatggcttcctttaagtcagggatcttatttttctctaatgcgtagtataagtatgctaggagcttttaaggtgttcaataagaataaattaaattaaatccagttaaatttaattagacagagacttcaaaatgtcaaagatgaactgtgaaatgagttttgattcaactaaattgcaactgatagaggatttaatctatattgattaaagttcagttttattacatttattttatctaaactgatgtttaaaatatatgtgattgctttattcttaaaataaaatgtaaacattagaatattcaaatgttcaaaactaaaatgtcaatcaggaaatatttttactataataatggaattggaacttaacatctaattgtctctccgatcatcgaaacatttaatacagatagcttgtaatatatttataacatgaagctatttcttaatcatcacaacatgtagttgccttttgttttcatcaagagttaaaatgtgtgctgtaactaaaaacaaacattgggtcatagtaaatttactactgtttaaacataaattagagaaaaagtaaaaattatactttgtgtaaaatttttacaactcttgtattataagagcaataaaagagatatgtttattggtacatagtaagtctgtttaccaacgcttttttaataacatcataaaataagaggacttcacatataaacattaactccgatatttcatttcagaaacatacacttaaatacaattgaagcttttgtttctttacatcttcccatttttttaatataactgtttcttattttactacatttatgaagacatcaaaatataatcaagcttgctgttgtttatctcatgatattaagtattgtatttggagattaaataatttcaactttatgtaagattaaaaaaaagtgttatatttgaaggtaggaaaataagtatagtttctggtttatggatgtttgcatgccttctgtgaagcgcctgatattgtgtactcgttttacttttgttttctttgtctttttacctattaatttataagacttttgattatagtagtgatataattttttaatatacgtgttgcaaatatgatttttaaatatattgttgatattctcactttatcattcttttattattatggatatattgtttttttctttattgatgtttgctttcccattattagcagtatttatgataagaaaactagtaataattgagtacatactatatgcccatttcatttaaagtacagcaggttcttggactaatatctcatatccattggtttattttactttagtgcctattttatcttcataaaattttccagaactactgccttaagccgattgttttcagttttggtgtttttttgtaattgccttgggattctttactcctttaatttttaaatttttctgacaaacacaaaatgatgaaaagatgaggcaagcctggtctataatttttactctggcaaacctgttctgtaatttttccattacttctggaaaaagcttatttatattcatttcccatgtcataatttccattatctctttctgtcattaattagactgggaatgagaagcttttgggtttgcaaaaccccaaatggatgatgccaataactatcagaattgttgacaacaacataagctttgagtatagtctgcaacttttaaatatagattttatttcttctcgagactgaaaaccatttcatgaaagttggttagagaatttggtcttaatctctgtatcagttaagagagttttggttttatgttatctaaattactgctaatgacttaaacaataagaatattttttatctcacagaaagtctttgagatagatgactttagggattaatttagaaccacaacaaaattacctggacacagaggctcccctgtctttccatcctgtcccttttagaatgctgaatttcttcctcagatttgcacctcaattgttagcactcttccaggcatgggagagcagcactccccaacctttttgtcaccagagatcagtgttgtagaagacaatttttccacggactaggggtgggggatggttttgggatgatttaagagcattacacttattgtgaaccttatttctattattattatattgtaatatataatgaaataattatacaactcatcataatgtagaacctatgggagccctgagcttgttttcctggaactagacggtcccatctgggggcaactggagacagtgacacccgaattatgttgcctatgtccagtctactccataatctcgttttggttactgtcactacagaaaactctgcttcacaaaggtaggatattggaaacaggagcaggcttttcagtgcttttgtggcaatctcaggataatctccaccttgactttaatccagaacatatggggatttgaagttgtctcaaacatacttttaaggccaccatcatttgtgatctcaagcagttgattcgcttctagcacggacaaagtccattcatctggcttactctcaaatgagttgcagatccattccttcccagttaagggctcttttctggtttggaagtaatgctccaactcttttgaaagctgagagaggtgatcacgcaccagctctgagtaagacggccctggctgtgtctctttcaaaatctttactaatatttgaaacatgtcagaaatcccaatgttcactcattgccccataattccagtttggctttgaatgcaattactttatctgatgacttgaacacagttgtcagtctcccctggagtgacagattaaattccttgaccatgttgaatgtgtcacacaagtaagcaagttttgcgatccattctgcgtcactgaaatatgctgccaggggtgattttttttctataagaaatctctggagtggctctcataactcaaaaactctggccagtgatctacctttagaaagccctctcatttctgtatgtaagagaagacgtgtttgctctgcatccatttcctcatagagttacgtgaacagatgtgagttaagggcatttaatgcggttgatacttttaatcacatcctgcaaaatgtttttaagttcaggtgacatttttcagttgttaagttcaggtgaaatggcatttttcagctagccacaatttctgtatgggtgacacggtgcatggactcacattcagaagtgacctcattgacctgagtggtgaaaccagaaagctgtccagtcatggaagccacttcatccatgcatacttacacaaaatgaccaattttcctgatgtgtaatcattcaaagactttaattgttctgcagctgtggtgttgttggttggccaaaaaattgcccataacatattctcatgcacatcctcctgaaaaatatatcacacaaaaccaagaattgttgccttgttgtcaacattggtagactcatcaatctgggttgtgtaccatggtgactcattaatcctctctagcaattgtgcctcaatatcttctgctatttcatcaattcatctggttatagtgctagctgaaaaaggaacttatgccaccttttaaactgcagcctctcctaaaagttcacaatggatgtttttagtagcaggtaggatcaaccttcaccagtagtaaaagacttcctagctttagcaatgcagttagccactaagaatgatgctgtcagtgcagacacatttgataaagtggtggccttcaataattgcttctattctttgtgttcacatttttttcttttgaaaaactgcagaggcttgtcttttaatacagggcgcttgatcgccatgtggagaagcagctttgaaggtctcatggcttcgttggatagcctgttgccacatattatataaagcaggattggagaatgtgaatcacctgttgcagtgaatctgcaatttaagtaggattcttggtattttcttttaaatacaactttcttttgttggcagtcacagagtcttttgatgtcccctcattgggtctttcccccttttcaaagaaatcttccagtgacatttggtttttactcattttggctatggttagcttgtgggcttaccaaaactgtgactgagacaagtacacagtgcaggaaagaggcgtgaacagaagtggtaaataaaataatgagagggccacgtatggactaaactaagtgtcagattctgacttaaagcctgccaccagatgcaactatacaattgaagtatatcaactcactactataactcctgccaccagatgcagcttgtcacttgccactcactgatagggttttgttatgagtctgcaagcaattgatttattatggtctctgtgcagtcaaacctctctgctaatgtgaatctgtatttgcagctgctccccagtactagcatcactgcctcagctccacgtcagatcatcaggcattagattctcataaggagcacacaacctagatccctcccatgcacagttcacaatagggttcatgctcctataagaatctagtgacactactgatctgacaggaggcagacctcaggaggtaatacaagttatggggaatggctgtaaacatagatgaagcttttcctgcttgcccattgcttgtgctgtgtggcctgattcttaacaggccacagagcagtataaatctgtggcccaggagtcagggacccttagggtagaggatgcttcttcatcatgtttttacccctttatctgtggagaaaacatttccacaaaatgcacagaaggcacagactcccatttccatcccattggctagactaggttataggtctatctttcaaccgcaaattgataaaagtgaatataatcaccattattagtttaaagcaatcaattaagattcagtcccaagaactaggttcatgatctatgtgcactttgcagcctaattcctaaccaaatcaggcttctgttagcaagcaaaacaggagtgaagtgctattgagcagatgaatatgtttctgatgcaaaattctcaggagttagtttgacagtatgcaagataacttaatcatccagtagattagaaaggctcattataaaaacaggacccttgaacttaaatataaaacttcaaactgttagaagaaatcattggagaaactctttgggacattggcctgaacaaagatttcttgagtaataccccaaaagcacaggcaaccaaagcataaatagagaaatgggatcacatcaagctaaaaagtttctgcccagcaaatgaaacatcaacaaagtggagagacaacccaccaaatgggagaaaatatttgcaaaccacccattttaaaagggattaataaccagaatttataaggagctcaaacaactcaatagcaaaaaatgaaataatccaattacaaaatggacaaaggatctgaatagccatttctcgaaacaaggcatactaatggccaacagatatatgaaagaatgctcaacataattaatcatcaaagaaatgcaaatcaaaactccaacgatatgttatctcactccaattaaaatggctgttatccaagacaggtaatcacaaatgttggccaggatatggaaaaaggggaactcttgtacactgttggttggaatgcaaattagtataggcactatggagaacagtatgggagttcctcaaaaatataaaaacagaactaccatgtgatccagaaatctcactacagagtatatatccaaaaggaatgaaatcagtatatcaaagatacatccgcactcccatgtttattgcagcactattcacaatagccaagatatgggagcaacatgagtgtccatcaaccattgaatgaataaagaaatgtggtatatgtacataatgggatattatttagccataaaaagaatgaaatcctatcatttacaacaacatagattgaactggaggacattatatcaagtgaaataagccaggcacagaaagagaaatattgcgtgttagcactcaaatgtgggagcttaagaaaaaaaactgaactcatggagatagtgagtggaatgatgtttgtcagaggcagagaaagatagcagggattgggggataaagtgagatggctaatgggtacaaaactacaatgggatagaggaagtaagatgttgtatttggtggcacaatagggtgactataatcaataatagtttattgcatattttcaaataaccaaaagaatggaattgcaatgttcctaacacaaagaaacaataaaagcttgaggtgatagataccccaattacccttatttgatctctgtacattgtattcctatatcaaaacatcacatgtaccccataaatatatattactgttatgtacccttaataattaaaaaattaaaattaaataaaaattataaattataaatacaggacccttgagatcattagtaaaatttcagagccctagtttttgtgatgttttagggccctagttcttcctaacgttctgaatgttggacatgactgttagtaatacaacagtctttcttagaaattggattgaggcctgggtgcattggcttatgcctgtaatcccagcactttgggaggccaaggcaggtggattgcctcaggtcaggagcttgagaccagtctggccaatatagtgaaaccccatctctactaaaaatacaaaaaattagctgggcatggtggccggcacctgtaatcccagctacttgacaggttgaggcaggagaatcacttgaacccgggaggcagaggttgcagtgagccaagattgcgccattgcactccagcctgtacaacaagagcgaaactctgtctcaaaaaagaaaaaaaaaaaaaaagaacaaaaattggattgactacttttgtctaggtaccatttaggatttattccttccaaatgctatggtaccattcagagtcacatgaccataaatatatttcatcacgctatttttctaattgtattctttagtcattttagggccacaatgggcaataggaagtttaggtaaaacatttcattcttcttacactggctgggtctcagacactcatctcttatatgaataattcttctgtatttatctttttaaaaaaatacatgtatacttctaagcaaactttctttgaagaaagtattttttttttctgagatgatgcttataggtagatttgaaacccatcattgtggaatccatcttgattactatatctgatgggcagactcatctattcccacataaattgataagaatttgagtgtttttgaagaaacaacaaacatataaaaacatttaaattagacttagtccctggtgacccttctgacattcatttctatttttccattctgttataatcagaattatattcattattatgataaatatggttcaacagtggtccaagatatactaaatcttacatcagaaaaaggaaaaggcttttccatttttaggtttacttaaatgagaagcaaagtgcactttcccttcatatctaagtatataaaatttgttgacaattgaatatcaaacaatgataattgactctcaatattttcctattgcagtgagagttttaatattattcaaaatcaattacgtttttattccaataattatttttacatgaagaaagacaatttcatatctacactctgtaaacttctttataatcagaggagcaattagttattttacttagagaataaattaattaaaacacataatttatttttccactggtattttagtatggttaacttaaccttaaggaagcacttgagctgtaaactgacggctctgctgagaactgggaaagcaaaaatgaatgcaaccttgatcctgttttcaaatttaaaatctagtatatattgttagtaaagttctgatagatgtcatggggaatccaaaactcagagggattttttcttgcctctaaagagtttacagtctggttgggggcttaaaacatgaaaacatacacagtaagtggcaagatgagttagtctcaattaaagtgctaaattacagggacagatgctacaggatgtcaggggtgggatgagctgcgtggccaaatatgcctactgagaatggggagcttgtgatgcactgtaaaggaaaagtagggcttgactaagtagaaaggagagagggcacatacgtttactgcaaagaatcacgttttaaacaatgatttagaaatgagtaaatgcctggtatgtgaaaagtttgggaaattcagtggacaatgaataataggcaggtctagagagaaaggagagaagagaaagaaagcagaggtcagactacgtcagattcctaagggtagtttaaaaaataagctaaaacagccaagccagtggaaagtttgaatatattctctttttccctttactcacttatcagggccactccccacccttctctcccttgccctttaccccaagactggcccggaggattacgtctaagggctcttctgccttctggcttgcagttagagtcagcccggggagagagggagcaggagaccagaaagaagtaacagagtggagatcatagtgtttcttccctggcatcctctgcagaattgctggctgaatctaagtctgaaggttgcagctcctgtcagatggccctgtccacacagccctctgggtcgtgaggtctagaaagcacgtccacctttcattatttaggcctgcaggaggtgcctgtgccctgcccttagccccaggatattccatctgatttgcctacaaccttaataggtagtttcttcattcgttctcatagtacccaagtgccatgtggtatctcttttctggtaggttcctgactggtagagagggaaataatgaaggaattgttttaagaaggttaatattgtggccgaaatagatagattgacaaactagaactagggagaaaattaaccaacagaaatgagcatttaagtgccaaatcaaggtaaagaaagtacagttgccattgggagattgattagtgaccaaaagtgatgaacaacaaaaacaacaacaaaacattaaacataaactaaatagtcatgaggatttcaagaatataagaattggacgggaattggaatttagttacataaaaaatcaacacgtataggatgaaatttgagtcactagtaaaattctagtatcatacacaaagtagaggataaagatctctaaattagaggagagaaaaagaattttagattgcaagttttagattacattcctatgttcatggagtaatgtctagtagaactttgagatgtgactggcattacagaaataggtcagaaatggagaacagtttaggaatattccaaatagtagtgacaccatgtcatcagagttgatgagttctcaggcaacgcagccacctaaagtgaagaacagagacctgaggacgaaatccttggaaaagactcccactaagcaagcctgagaataaaaagaaggcagtaagaggaactgagaaaaaaattccagagagatagttggaaaaggactcatagggtaacaattaataaagaggctatttcagtgctgtgtagcttatcatgtggttcaatcaaagcatttctgtttaatagtcaataatttgtgatataatttttgtcatgataagtattataacatgattaaaataggaaaaggaatattatttctttggatggcccaacacatccaagtggtatcaactgctcttccctctctgggttttggtttcaatgtagaggattctcatcaactgaatattcttctcagtatagatatgcatgtagagggatggtgctaatgacttcactgtaacaaagatatggataatttggaaccctcattcattattgttttgcaagttcttctggaggaaataagtcaggtggggattttcacgtatcacctgttcaagcaatatgtgaagtgcaatagcacccagatccctcccatccttaacagacactggaccttttaaaactatttttcagcactccttttatttagcgttaggtcagttccttgcttttactctgttttgaggctactgtaatagaaaatggggcaagaagaatgtcattgaaatatttagcttgctaaattaaaaagaaagtaaaagcaaaatacttttttttcctggttatatttcagtgactagttttaattaaaaactctattcactgattttttttaaaaaagatttttactacctgatctttatgcattcagtatggcctatgtgcgaaagaaggggtttgattatagaacataatgatgtaatgatattctgtagaggacaagtctgtctacatgcaaaattacttaatgcaaggttacttaagaccctttgcatttcagttggattatgtcatctaccttatggatttgcaaaaaaaagtcgacagagacaacttgtggaaacttgtggaatcaagggacaattggtgttcagggaagggagtggcatggaagattgagaaagaaccacaggaaacaagatgtagagggtccagtaaataaactctctgcatgtaaaaaaatgtactgagtagttataatttatacttactgttaatagcctgataaaatgatacctgtgcaagaaagtagagctaaggtgtaaaaagagaagaaatgattatagttttttgagaaaagagatcagagaaataacaatataacaatttaacatatacctgccatttaatatatagatttgataatcttaaatatttgaaaaatctatataaatataatcaggtttttaaaaaaatactaaaaataaatatctgttgttataattttttagcatttaatacaaatcttttcctcagtcattctgtatgtgactctaagctcacacagttaacaaaggacaggaattgagtcagctgacacattagagccaaactgcctaacttccaacattgaccctaccagttaccatctgtgtggccttaagaatgtgccttagccttctgggtctcatttttcttattttttaaaatgactattttaacaaactacttcatagggtaattatgagaattcagtgagtcttgagcatggtgcttaataggaagcatattatgccttaaataaaataagacaaaaaagactgatgttgcaagattcatatatatatataaaatactcatatgatttgcagctacaaatatatatatatatatatatatatatatatatatatatatatatttttttttttttttttttttttttgagacagggtctcactctgtcacccaggctggagtgcaatggtatgatctcagctcactgcaacctctacctcctgggttcaagcgattctcctgcctcagcctccccagtggctgggattacaggcacacaccatcatgcccagctaatttttgtatttttagtagagatggtgtttcctcatgttggccagggtggtcttgagctcctggcctcagtgatccacccatctcagcctcccagagtgctggtattacaggtatgagccactgtgcctggcccaaaaatatacttttaaattaagagaactgtactcatatcaaggggaaaaaataattatttgaagttacattattttttagaatgtatgtaagtattgaatccaggtgtcctggttggctctcctattgcctagctatgggaacctgagcagtgaagagcttcactcgtcccaggttgctgtgaagactgatacagatgaagtgcctggcagcagaaggtgttccacaattgccagtagtttatttcttcttcaacaaatccatccctctctaccctcttgggccatgaattctgagtatcaaaattctctctccccatatctaaagatcagtgatttgggggaaatttgtttttaatttgattctatacagcactttttttctttgggaaatgctgttcacatcaaggatgtcatcttttcttgggagaaaccatcctggttagttttcccttaaggtttacaatggatatacagttccaagagtataaagagatctttgtcagttgtgagattatgaatccaaggttcaaggttctgaagttttgctgtagtgtgaatggcaaggacagtctttctatgatgttctcataagatccaatcttcgggttctagattgtgaaggggttgtcctcagtgaaccacaaaaagctttctttacctggtgaaaatatactgtaacataataatctactgttataacatcaacactcttgcatgggaaagcttttatacaatcagaaaacattcattgaaaatgacaattgggctgggcatggtggctcatgcctgtaatcccagcgctttgggagactgaggtgggtggatcacctgaggtcaggagtttgagaccagcctggccaacatggtgaaacctgtctctactaaaaataaaaaaaattagccagtgtggtagcaggcacctgtaataccagccactggggaggctgagacaggagaatcgcttgaatccaggagatggaggttgcagtcagctgagattgtgccattacactccaacctgggcaacaagagcaaaactctatcgcaaaaaaaaaaaaaaaaggaaatgacaattgaatgaaatttctttataaatgtttatgtggccaatcaggtagccaaatgtacctgaagctttgattgtcttcctgggaatatggaaccacacattggttttaaactatttctgcaatttataagtcacctcatcaatatattcaaattggatcattttatattttccatgataagtcatggaatgcagaacctttaatagcagaagctttaaggactcaggaaggacaaggcagccatcctggttctccgtgagtccatgcttaacattggatttatgtcctcttgaataccagttgattctccaatttaggtatatagcactgataactaaggggttatcacaggtaatttgacttagactgtggagttcaaattgtacacctaaacaatttcagtatcagctggtttaacatgaatatctggaaaagtattttcttggtatttaattaatttttgttctacttgggttagcatttttatacaaggaaatttggttacttctatggtgtacaataacataataacgttaattatgattgacagcatatactcagacatattagaattttagaaatcccatacaattttgaaacatatcttaatatcattcactaaaatataacctgaagattaaacattatttttatgttgacaatgcttcccatgtaacttaacttgttaaagaattctgtttacctgtctttgggatgctttaagtgccctctgtatcatcccaaagttagagatcagaaaagaccattttgaagcttaaatttgattttgggaggcctattaaatatgttaaatgtttaaaacacttgatattgtaaactagaattccaggttaccataaggcattcatttagccaaaatgatgactcaaaaattttttaaaaggcaaaaacctttactcattgataaagggaagacttagatttgcaagcagtctgtcttttgtctttcccttctttatttgtgtgtgtagtgtatttaaaaggcaaacaaaaatttttcttttttttatttcttttttttctttttaagatggagtctcactgtctggcacaggctggggtgcagtggtatgatctcgactcactgcaaccactgcaactcctaatctcaagtgatctgccctcctcagcctcccaaagtgctttacaggcatgaaccaccatgccaggccaaaatttttcattatcttttaatattacatgaaaatcttgttgaagagagaaagccaaatttcacccttgcactagtggactattaatgtcaaccccaattttcagtaaaccttgtatacaaatctatccaatcctaatcaatttgaccataaggtgagatttttataaaccttttataaccctttacaaatttttgttaaagagaaaacttgtgctttaagaaaaccctgttgtgcttttatttacatgtccaatttactgaaaaacaaataatatccctttagtgaatattttcacacagagtgttttcacaaggttaatttttatataccttccacaacttgtttaaacctttagtttatttaatttaaaacaatcctttaacctaaactaagcaaacatttacattctcataccttctaataatctcttaccaaaacacatttcattctccttacacaccttgtatgtaaacctattttttcagtagtctcaattacatgttatagtggtaatttttaacaattttcacttttggtgcataaattttcttttataaatcctttcacaacttatacaggctatctacgacatccttggactttctgacttgtcctaaacatccctctttttaaacaacccgtcactttaggacaagaatttaccatgaattatatgaattatcttttctttataactttctttgcatagcaaggaagcatggctaattccacatatccctaggccttatttagaatttaatgtctccaaaataaattgaacaattttcaaaagttaaagcagtttatgaccttaaagcatttagcaaacctaatatctgacctgcataagttagaccaaatgtttttattttactaataatctttaaagctgttcttatttcccaaaggttactaaagttacaactaaaagacattactgtttttatttcactttcaaaatatttgatttaagtgcttatttttgtttaagccaattaattagcacttttttatataaacattacatacacaacacatatgtaactacacagacagacagaacgagattactacaatagttgtaagatttttcatttgcctgtttttaagtttcttaattggttattggctttggggtggggtccttggaagaacagagccaggaaaggctctctggtgcctcctgtttttcctaaggagtccagactgtgagagtttgaataaccgcttttaattaagctgagttttaaccacaggactctttaataaagtccttttaaaatttagtattacctgactttagataggccaaatggctgatatttctcacttttgaactttacgaaaggtaaccttccaggtgctcggagaaaggaaaatttaagacagtccgtggacaagaagagaatcgacaaggatacacagacattaaaccagaaaagactcattttttaagctgagaatcaaacctcgactgccactgtgaaagggaaaaaatcttagctactgagctacagcacaggctggtctaaattgccattgccagttggagtctgtagtagttaattttgagattgcaaaggcttttaactactccagataatttttagagctaattacgacctgaaccctaaaattcctgtaccctggaaggcagagaccaagagaaagtacccccatgtggttacaaggttaagctctcaaagacataaaacaagatggagacctcatcagtttttttgtttatttcagggacctgcagcaaagtttgttagtgaccatcttgctgggtcatcttgagcagtgagcttatgggggcctaagcccgtattttttcctaaggtactcctggacacagaaaaacaaattcatagcacaaaatgcaccagatttattacagcttaagactagcctcagaattcttttttgcattaatcaaaactttacaggggagataaagtgatttttaccattcattccactgtttttgcacagggagagaaaagccagaaatctgactggtaagaaactcttacccttttgccaggatgccaggtttctgggttttctttccttgagcggccctagtgacccagctcaccataccatagccatggaggccaacccacaacacagaagaaaatctttttctttttttttcactgtgttgttgttcatttggaatgttctactataagttatctttagtaagattttgtcatttctgtaagactttactgcctcctaggcctaatgtataagccagaaggaactcagttttccaaaaattgaggatcccattttttatctaaaatattggctttactctcaggttctcttcattaacttagtcaatgatttttcctacctaagcatgcaagaaaaatgacacaaagggatagaacacaaaaatccctgtgaattttttaaagccaaattttataacccctgcaatactactgcttcctaccagtccctttctgacccagtcagaggtaagagacctctaactaaattcaagacagttaattcccaaatacaatttgttcccggacccagtccagtttctatcatgacttgcaaacccagtttggatgagaaatgtgctcaaagaaactcagagagctcaaaacacaaatctgtggagctccaaaatctgaaagggagcttacccacgatccccagctgctctgagagatcaatggacacaaatgggtcctgcaggtaccttgcgggttcagtgctcctgggggttgctagaagctttactttggatcccacttctgacaccatctgttagaagaaaaacttcagctgaattaaatttaatggagtttaattgagcaatgaaccattcatgaatcaagcagccccagaatcacagtggattcacagagactccagcccagccacatggtggaagaagttttatttatagacaaaaaaaaaaaaaaaaaagagaaatgacatacataaatcggcagtgaggtacagaaacaactggattggttacgggttggcatttgccttatttgaacagaatttgaacacttagcagtcaatgggtggttaaattatggccattgggattggccaagactccgttattgttacaggtgcctacttctaagttaggttttcagtcttgtctgactattaagctaggttacaattcatccacagggactcaaatatagtagtacagagtccttctcaggtcatatttagtttgctttaaccgtttctagtaagttccttattaaaatgcaacataggccaggtgcagtggctcacacctataatcccggcacttcgggaggctgaggcagggagattgcttgagctcaggagttcaagactagtctggccaacatggcaaaactctgtctttacaaaaaaaaaaaaaatacaaaaattagcctgacgtggtggtgcatgcctgtagtcccagctactttgagggctgaggaaggaggatcacttgaacccaggaagttggggctgcagtgagcctggatcatgccactgcattccagcctgggtgacagactgagaccctgtctaaaacacacaaacaaaacaaaacaaaaaacacaatataaataattgttgaacattatgtttttattagatgtcgaaatataaaaactagaagcagaatgttaaaaacataagattaagtttcaggataagctttcctcctttgatagaattactttctaattacaggtttctttttcttttctgatgtgatgtttaattttatgtgtcaacttgactgaactaagagatgcagagttagctggtgaattgttttttctaggtgtgtctgtaagggttatttcagaagagattagcatttaaataaatagactgagtaaagaagatcaccttcaccaatgtgggcagccaacatccaatctactgataatctgaataaaacaaaaaggcagagaaaaggtaaatttgctctctctgtttgagctaagacatatatctcctgcccttcagacatcagtgctcctggttctgtttttctggagaaccttgactaatatgcctgctttgaagaattcctagtctaaggcaggaattataaacttttagcttggttctgctacttgagataaattattatgaaaatttaccgcttaggcatccaaaaaatataaacactttaaaagatccttatctgttctgttaagtgattgtattctggtatcttccttatgatcaattcacttttatagacagttttaacatctactatgtgttcatttggcaattaatacaaaatagtttctgtattggagataatgatgatggagtgggaatgggtagaaatgcatctgatagcttcagtttaatgctatgaatagagtgactaaagtaagcaaagttcattgtgggcgcaagaagttggagcagcagacccagattagagagctgaggagagacttcctagggttagtggagctccttttatatgtgttccttgtaagatgtcacctggaaagaatgatcaaaattgtgatggtattatatatagtggtttcaaccttgatgatcattcttccaattaaaaataatgtttatatttactttagtgtccttgtcaactatgatgactacaatttatttctccttataagcttgtcatttgtgtgaaaaccatgcatatttgtatataataatactagcagttgaaacttttttctatttttaagctttttttcagataatttttaaatgaattgtttttgcccacctttagaacttggtatgcataatttgaattgggcaacatgtatagctagttgaatacattattcaaaatcaggacatgctggctggctttggttccttaaagaggtgactaagatgttactcagccaacatgtaaataaatacacacagtcacaaacaaaattgttttcagtaaaattaggtaagtaattgtttttttcaaagcgtttacattatattcacatagaatagtatgacatccaacgaacacagttctgttattcttctattattagtagaaaataaaccaaaaattatttagagcaggaccatgaaattttaccaaggcaaacaaaattcctaacctttggtactttactcctaaaagagcttaatggataacatattttacttatactcaacatataaatataacaagcctggaaatggaatttccaaggccaaagaaaattaaatgtaaaacattagcaggcaacagagaagatatactaagaggaaattaatcaatttttaaaaatctaatactataatttttaaggtactttacagttcacaaatatcaaatcttattatactcttttataccatatattacataaaatatcactgttactttatgttgagtattaaaaagtattttattttatttttttattatactttaagttttagggtacatgtgcacaacgtgcaggtttgttacatatgtatacatgtgccatgttggtgtgctgcacccattaactcgtcatttaacattaggtatatctcttaatgctatccctcccctctccccccaccccacaacaggccccggagtgtgatgttccccttcctgtgtccatgtgttctctttgttcaattcccacctatgagtgagaacatgtggtgtttggtttttttgtccttgcgatagtttgctgagaacgatggtttccagcttcatccatgtccctacaaaggacatgaactcatcattttttatggctgcatagtattccatggtgtatatgtgccacattttcttaatccagtctatcattgttggacatttgggtttgttccaagtctttgctattgtgaatagtgccacaataaacatacatgtgcgtgtgtctttatagtagcatgatttataatcctttgggtatatacccagtaatgggatggctgggtcaaatagtatttctagttctagatgcctgaggaatcaccacactgtcttccacaatggttgaactagtttacagtcccaccaacagtgtaaaagcgttcctatttctccacatcctctccagcacctgttgtttcctgactttttagtgatcgccattctaactggtgtgagatgatatctcattgtggttttgattttcattcctctgatgactagtgatgatgagcatttttttcctgtgtctgtcagctgcataaatgtcttcttttgagaagtgtctgttcatatccttcgcccacttgttgatggggttgtttgtttttttcttgtaaatttgtttaagttctttgtagatttcggatattagccctttgtcagatgagtagattgcaaaaattttctcccattttgtaggttgcctgttcactctgatggtagtttcttttgctgtgcagaagctctttagcttaattagatcccctttgtcaattttggcttttgttgccattgcttttggtatcttagtcatgaagtccttgcccatgcctatgtcctgaatggtattgcctaggttttcttctagggtttttatggttttaggtctaacatgtgagtctttaatccgtcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgtcccactggtctatatctctgttttggtaccagtaccatgctgttttggttactgtagccttgtagtgtagtttgaagtcagatagcgtgatgcctccagctttgttcttttggcttaggattgacttggcaatatgggctgttttttgcttaaatgttaaaaagtatttttcacataagataatgggataataattttatagtttttaaaaaattaaagtaaataataggaattatctggggacttgatcaaatgaatgaaactctagatttgaggatggcagtttcaatctttgagctaaatctaggctgcagtctctttttcttaataaagtttttatggaacacagccacatccattcactatatatcatttatgactgctttctgctaaaacagcagagtagaataattgtgacagaaactatatggtctgcaaaactgaaaatatgtactatattgtctattacagaagaagtttgctaatcacctctctaaatggaaactactgaagaaatgagtaaaatattagaaaacattcttgtaaacacattgttgatttggcaataaaacaaaaaattcccagaaacttaggtaataatcagttggataatatcattaattaaaagattctatttaagtagctatacaaaagattgagcacttaagaaaaatatagtacactgtaagccagtacttttggaagaacattatacattttctttgaaagatatcacagaagggttcaatatagctaaattacattcatgaacagaaacattcaatatcttaaagataagtgtcccctaatgatttatacatttcatgcaattccattggaaaaaaaaatccaaacaggttccttgtggaacttgaaaaggtaattttaaaaactataccaaagagcaaaaggctaagaatacactagatatccctaaagaagatacttgggaaagaggagcttttcctattaggtataaaaacacaaaataaagctataataattaatactgggcactagcgactgataggtaagcacactgatatgtaagcaattccaaaaatgaggtccaagtaaaaaaaaaaaaaaatcttttttttttttttttttttttttttttttgagacagagttttgctcttgctgcccaggctgcagtgcaatggcactatgtcggctcactgcaacctccgcctcccaggttcaatggattctcctgcttcagcctcccaagtagctgggattacaggcgtgtgccaccaccccggctaattttgtatttttagtagagaaggggtttctctccatgttggtcaggctagtcttgaacttccgacctcaggtgatctgcctacctcggtctcccaaagtgctgggattacaggcttgagctactgcacccagccacaaaagaactcgatgtagaacagtgacatgaagagcagtgagtaatgtgggttcattcatttgggtaagggcagttggttatacagacagaaaagataaaactgcatgcctactttacaccattcataaaacttaatttaggcatcacatgcctaatgatgaaaggaaagacttcgaatattttaggtgctcttttcttcatggtatcataacagaaaacaccttaagtaacagacttacagaaggaaactatattgatacctgtttaaaatcagcagccatttgttcatccagagatattctaagtaaatgaaaagacaaggcacacactgagtgaagatatctgcatcatacacaaatggcaaaggattaatacctggaatgtatagtgatcaacaaatcaaaaaggacaatataatgaaaattacaaaatatataaattggtctattacagaacagaaactatgaaataaattggcaagtacaagtatgttcaaccactttagcaatcaaggaaatgtaccataaataatttgtacatttaaaaataaatctcagtaaataacaaaaatgtacagtgaatattatttcttacaccaaattggcaaatgaaaaaaaattagacaatatataatgatggagaaattgtgaagaaataaacattggaggtgttcctactgctgatatgaatataagaatttgtgttttggaaaacgggttggtattagatgctctagtgctaacatggcttataacaaagaaatcgtatccatagtcatatattttagagatactattatatatcaaatgaggtaacatgtacaagaatgcttctatcacaattgcttcatagctaaatgctgataaaaatataaatgttcatcaacaaaagaatgaataagtaatttgagtatagcatacaacaatggaaaatgaatggactacattaaacattaacatggttgcatatgctacctttatctaaatgggagaaatttggtttctttatccagatagtgggcccaaagtaattcattttatcattatttttcaatggatatatgattataaaagtagagcatatagttaagaaacttaatctctttaatgaatatggagcaaaaataaaattcaaagtgtttattttaactatacacaaaaattgtttaatttagtctgctagtatttttgtttagtagtattctgtttgcttatatgttttagggtctggcgatacacatgtaggtttaacacaggcaaattgcgtgttgctgagtcttggtgtatgaatggtcccatcacccaggtagtgagcacagtacacaacaggtagccttccaacccacaccctcctcctacccactcaagcagtccccagggtctatcagtcccatatttgtgtccatgtgtattcaatgtttagctcccacttatgaggaagaacataaagtatttggttttctgtttcttcattaatttacttagataatggcctacagatccattcatgttgctgcaaaggacatgattttgttcttttgtatggttttgtgttagttcatggtgtatatgtaccacattttctttatccagtccaccatgatgggcatcttggttgattccatgtctttgctattatgaatagtactgtgattaacatatgagtacatgtgtctttttggtagaataatttattttcctttgggtatatacccagtagtgggatggttgggttgaatagtggttctgttttaagttcattgaggaatccctacactgctcaccacagtggctaatttacattcccaccagcattgtgggaatgtaacctcaccaacatctgttgttttatgactttttaataatagccattttgactggtgtgagatggtatttcattgtgatttttatttgcatttctctaataattagtaatgagcattttaaaatatattcactggtcacatgtatgtcttcttttgagaagtgtctgttcatgtcctttgcccatttttaatggggtttttgcatgttgaattatttaagttgcatataggttctggatattagatctttgtcatatgcatagcttatgaatattttctcacattctgtatgttgtcagtttactccgtttatagtttcttttgttgtgtagaagctctttagcttaattaggtcctacttgtcaagttttgtttttgttgcaattacctttggggacttagttataaattatttgccatggctgatatccagaatgatattttctaggttgtcctctagggtttgtattgttttaggttttacatttaagtctttaatccaccttgagttaatttttgtatattgtaaaagaaatgggtccagtttccattttcttcatatgactagtcagttatcccagcaccatttactgaataggcagtcctttccctatagtttgttattgtcaactctgttaaggatggtggctgtaggtatatggctttatttctgcattttctatcctgttccattggtctatgtatcttcttttgtactagtactatgctgttttggttactatagccttatagtatattttgaagttagataatgtgatgcctccagcttcgttctttttgcttaaaatttgtttggcaattcaagctattttttggttccatatgaattttgtaattgttttttctaattctgtgaaaaaatgatgttggtagtttcataggaatagcattgactataattgctttgggccgtatggccattttaacaatatttattcttgctatccacgagcatggaatatttttccatttgtttgtgtcatctatgatttctttcagcagtattttgtaattctcattgtgaagatcttttacccccttcataagctgcattcctatgtgttttactcctttgtggctattgtaaatggaattgctttccccagactgaactggaagaaactgaaatcctgaacagaccaataaccagttccaaaattgaatcagcaataaaaaacctactaaccaaaaatagtcctggaccagatggattcataattgaattctaccagacatataaagtagagctagtaccattcctagtgaaattattccacaaaatcaaggaggaggaacttcctgattgtatgaagccagcatcattttgatgccaaatcctggcagagctataatgaataaagaaaacttcaggccaatatttctgatgaaatagatacaaagatcctcaacaaaaatactagcaaattgaatccagcagcacatataaaagttaattcaccacaatcaactaggcttttattcctggggtacaagactatctcaacatacacaaatcaataaatgtgatttgccacataaatagaattaataataaaaaccacatgatcatctcaatagatgcagagaaagcttttgataaaattcaacatttcttcatgtgaaaaaccttcaagaagcatttatgaggaatttaaacaaatttacaaggaaaaacaaacaacctcattaaaaagtaggcaaaggacataaacagacacttttcaaaagaagacatatatgtggccaacaagcatatgaaaaaaaactcaacattactaatcattagagaaatgcagatcaaaaccacaatgagataccatctcacgccagtcagaatagctattattaaaagtcaacaaataacagattctggcaagattgtgagaaaaatggaacacttatacatttttggttgggagtgtaaattagttcaaccattgtggaaagcagtgtggtgattcctcaaagagctaaaaactgaactaccattcaacccagcaatcccattactgggtatataaccaaataaatataaatcatcctatttgcattaatgttcatcaggaatattggcctgtagtttctttatttttaaaaaaatttatttatttatttttttggctgtgtcctagtcttgttttgctgtgtgggtaatgctgaccttatagaatgagtttgtaagtattcccttttctttttcttcttcttattcttcattctttttggaaggatttcataagagtttatattagttagttccttaaatttttgttagaatacagcagtgaagctgtaatgtcctgggcttttgtttgatggaggactttttattatggctttgattttgttactcattatttgtttgttgagattttctatttcttcatggttctatcttggtaggttatatgtgtccaggaatttatccatttttttctaggtttctgaatttgtcgttgtatagttgtttgtaattctctctaatgattctctgtatctctgtgatctcagttgttatgtctcctttttcatttcttatttaattttggtcttctctcttgtttttaaattaatccagctgaaggtttctctactttgtttatcttttcaaaaaaccaccatttcactttgttgatcttgtatatattttttttcagtctcaatttcatttatttctactctgatctttgttatttcctttcttgcttgcttttctagttcctccatgtgcatcattatgttctttatttgaagtttttcaactttttgaaacaggtatttacttctatgaacttatctcttaatactgctttttctgtatcccacagatgttaatatgttgcatgtcaattttcatttgtttcaaggaatttttaaattttcttcttaagttattcattgacctattggtcattcaggagaatgttgtttaacttctgtgggtttgtgtaattttcgaggttcctcttgttagaatggcttttataaaaaaaattcagagaataacagacgctgttgaggatgtggagaaagaaaaacccttgtacactgttgatgagaatgtaaattagtatagccactatggaaaacagtatagaggttcctcagataactagaaataaaactaacatatgctcccgcaattctactgttgggtatttacctaaaagaaaataaattagtatatcaaagggatatccacactcctatgcttattgcagcactattcacagtagcccagatacagaagcaacctaagtgtccatcaatggatgaatgaataaagaaaatgtggtatatatacacaatggaatgttaatcagccataaaaaaataaaatcatgtcaactgcaacaatgtggttggaaatggaggtgattgtgtaacgtaaagtaatccaagcacagaaagacaggtatcacatgtgggagctgaaagagtgaatctcataaagataaaatgtaggctggtggttatcagaggccaagaagggtgggggtgatgtgtggtgaagagaggttgattaatgggtacaaatacacacttagaataaataagacctggtgtttgatcagtaggatgattatagttaacattaatagattgcacatttcaaaatagttagcggggaataattagaatgatcctagataaaaaataaatatttaaagtgatggacatcccagttactctgatttgattatataaatgtatgaaatcatcacatgtatctaaaaaatatgtgcatctaatatgtatcaataaataaatgccacattgaaaaattttaaattattttcacattgaatttaggctgacacagttatttcaatttatatctcagcttattcaactgaatcttctttataagactatattaaattcagagtaaatgaaaatgtgagcaattgaatttagtgttatgtgggagaaatgttttcctttgaataagacaggagcaatgtttctagtttatgacaagaaaaagtctgtgatattaagctcccaaaatgtatcatcttttatacaaaattcagatcatatcagagcagtcaatttatacatggataaagcatataacaaatgaatgatggtaatccattaagccaaagggttttataacttcaatagctagtgaacatgtggtgagcagttgtgtatgaatacatataaagtatgcatttaaatgtacactccattaagtttttaataaaccttatgtgctaactttaaaaaatttatgattatttaaattagtcactaacaacttctttaattaacactaaatttcacattataacacagaaatatttttagttcttcatgctcgctcttccaaaaattgttaatatgcttatagttatattttttacagtgtaacatccaagtatggaggggcaattctaccaaatgatatgctgaaataattatttccagtgactgaatgatgttacccttatatatcagacagatcaatttcccctaataataggaaaattttaaaatttcaaataatagtagtactgtagtagtgattatataacagtagtacagtaacggcaatacagagaaccaataatgtttagaaaattatgaaatatagctcaaattattttattaattggtttaatttttaaaatatatatctggttgaattaaatattcaataattcctactgaaattcatgaaaatgctgaatcatgatgggtgactgttggaatttagttaataactaactgggcacataggaagaagaaacgttctgcctctttacgattaagtaagaagcccaaatctacctgaacagaaaagggagactgttgttccagtcaatgctgaaggttttgtttctctgaaacaaattcaaaataacaacaaaccaatgcaaataggagtacttgagatccacttgagattcaattcatggttatcagccaaactgtgctcttggactaataggatgcagcctgagctgttcaggagactttatgttgtgagtaatgtgacacttatcccagtaacttgttttctctaagttctccagttactttatcatgaatatcgttattctttgctgatccactccttttcttgcactcttatctttttataaagtagtaagtgtatagctctttaaaagatttttgaaataatttaattgacaaataagtttttttttaaattattatactttaagttttagggtacatgtgcacaatgtgcaggttagttacatatgtattcatgtgccatgctggtgtgctgcacccactaactcgtcatctagcattaggtatatctcccaatgctatccctcacccctccccccaccccacaacagtccccagagtgatgttccccttcctgtgtccatgtgttctcattgttcaattcccacctatgagtgagaatatgcggtgtttggttttttgttcttgcgatagtttactgagaatgatgatttccaatttcatccatgtccctacaaaagacatgagctcatcattttttatggctgcatagtattccatagtgtatatgtgccacattttcttaatccagtctatcattgttggacatttgggttggttccaagtctttgctatcgtgaatggtgccgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtaaaagtgtgcctatttctccacatcctctccagcacctgttgtttcctgactttttaatgatcgccattctaactggtgtgagatgatatctcattgtggttttgatttgcatttctctgatggccagtgatggtgagcattttttcttgttttttggctacataaatgtcttcttttgagaagtgtctgttcatgtccttcgcccactttttgatggggttgtttgtttttttcttgtaaatttgtttgagttcattgtagtttctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttgatattttagacatgaagtccttgcccatgcctatgtcctgaatggtaattttagcctaggttttcttctagggtttttatggttttaggtgtaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagctgtagatatgcggcgttatttctgagggctgtgttctgttccattgatctgtatgtctgttttggtaccagtaccatgctgttttggttaccgtagccttgtagtatagtttgaagtctggtagtgtgatgcctccagctttgttcttttggcttaggattcacttggtgatgcgggctcttttttggttccatatgaactttaaagtagtttttttccaattctgtgaagaaagtcattggtggcttgatggggatagcattgaatctataaattaccttgggcagtatggccattttcacgatattgattcttcctacccatgagcatggaatgttcttccatttgtttgtatccgcttttatttcattgagcagtggtttgtagttctccttgaggaggtccaatagatgcagaaaaggcctttgacaaaattcaacaacacttcatgctaaaaactctcaataaattaggtattgatgggacgtatctcaaaataataagagctatctgtgacaaacccacagccaatatcatactgaatgggcaaaaactggaagcattccctttgaaaactggcacaagacagggatgccctctctcaccactcctattcaacatagtgttggaaattctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagtattcttatacaccaataacagacagagagccaaatcatgagtgaactcccattcacaattgcttcaaagagaataaaaaacctaggaatccaccttacaagggacctgaaggacaaataaattttaaaaatgatacacacatatgacaaatataaccctcacagtaggaatcaatggtaaattcattactctcattactatctaatacgtatatatagtataggcattggagagtctttgttactaatacattgatattagttggcttgcttatcacctacaattaatgtcttcctatctatatgtagaaattatttttccttggatgttaccaatgccttccttttattaagatgctgtcatcttgatccttctttcagtttttattttatttaagggaaaaaatatcaaaatgagattcaggctcttgaggacattttttcctattacaagcaataatttatgtagaaatttttggtttactttaccagaatctccacctttatgagaaaaggcttggatgccatggtctggttgcttgttctgaataattttgttactcacttcataatgcgttgataagggcaagcaagaaaaaacagtccaaacaacagaaatggagaaacggaagtaggtcttgtttaaaagaagctcagttgcttcaatctattgaatgtcagtctgctttataccatggtgaagtagcttgcctcagaccagtccccttgctgagaacaactataaaagctgaataacaccaaattaataacagtttgaaggttttgaagagcaatcaagggaaccaagattagagtggctataattcaagaaagaagggaaatacattatttcgagccagacatgtcctgctgcttttccttagagacatccaacagcttgcaagcatcataaggataaataaatgagcagaaaatagtgaatagaacttacaggaaccttagaatgccagagcaccatgaatctgagtttagtctaccaggcagtcaggccttgaggggccaagatactgagaaaagggaaccagagaaaatggagcttgaataattattttttttttttgaaatacacatctggttgaattaactattcaatagttccttcttacatttatgaaagtgctgaatcatgatgggtcatttatatatatatatatacacatattcatatatgtatatgtatagatttattataaggaattagctcaggtaattatggaggctggcaagtccaaaatctgcagaggtgatgtccaagtttcagtatgatggctgaaaactgctatagagccagaaagagctaatgtacctgttctcaagctgtcaaggaggataattctgtcttattcaggggaaggtcagccttttatgctatacaggcctttaactttttggataagacccacccacagtatggagggcaatctgatttactcagtctatgtatctaaatgttaatctttaccaatttaaatcagaactcatccaaagacatctccagagaaacacacagaaaaatgtttgaccaaatatttggacactccgtgatccagtcaaattgacacataaaatgaaccatcacagaatttgagtaatatgtagctacaaatttaagaagtagaactttcgccagtctcatgtattttatagacagaaattaggagtcctgggtctgtcaagtataagaggtcctgaaaaatatgtcagtctatcagttgaaacccagaaccaaaacactgtcctaaagactgaaaaccagtctcaaaatacctcaattattggttggggccatttagtctgctcctatactaattgactgtgagaaaaataaagtacctcagagaaagatgacatagctagaacaatcaatggttttcatacacaacatccagcattgactaaaaagttatcaggaatgtcaaaacacaagacaacattttttataaacaataaaaaatcagtagaaacaaacacacaggtaatttagatattggagttattagttcacaataataataatatttccaagatcatatctgacaatgaaagaaactagaattgtgaacaataaataagaaaatggaagcttcataacttaaaaatgtaaaatgaaattaataactcaatagatgtagttattagcagattagacactgaagaagagagttactaaactggaaagttgattagtagaacatgtcataagtaaatatgaagaagaaaaaagatgaatgatagaaaagaacataacttagatatgagaaatgaaaaattctgataagtatgcaattaaaagcccaacacaaggataaataagaaatatagtagaaacaatatttagtcctgcctgaagcagtactgattgaaatttttttctgactgtggaaagacatctaataacagatttaagttgctgtatgaattacaagtgaaacaaccacaactagacacattaaaattaaactaatgtaaatcaaaggtagttaaaagtcaaagtagacaaaaaagaaacacactccaaggtaaattttaatgaactcgtaacaaataatgaatgccagagaacaataacatatatttttaaagcattcaggaaaaaaagtaacttctgacctagacttttataaccagtaaaaccatctttttgaatgaaggcaaaataacgttgtattcagacaaagagtaaagaaagatctcattgcaagcaaagttacagtaaaagggatgacaaggagacaaactttggcagaaacaaagttatccagaattcaagtacagaaaagtagaaagaactgaagaacaaagaaacttcttggtgaatatgtggataaatctaagtattagctgactgtataaatcaatattattccttgtgaagttcctacatgtatatagaaataaaatacatcagaagaagcaaaaacagcaatagaatagtgtaaaaaaatttttcaatccttgcctttctgagaagtggaaaaggtaatatagcacttccttcttatctgtggtttcactttccagtttcagtaacctgaggtcaactttggtctgaaaattccattattatgtttaaatttttttctaaatttataatttttctatttaattaatagttatttttgttaatcttttattgtgcctaatttataaagtaaactttatcatagatacatatgtaaagaaaaaaacacatataggattcagtattatctgcaatttctgcatgcaaaaacagtctggaatgtatcttccatgcataatgagggacactgtaatttagggtacactttagtaagacaaggatgcattggtaataactagactaatcaacaaaatgataatgaaagaatatataagttaaaagagaacaaaatatagaaaaatatttgattagctcaaaatttagcaataagtaggaaatgacacaaagaaatagaaaaatagcaaatattaagatggcagatttaaaagcaaatatacattaaacgtaaacagactaaatactttcattaaaaaagattgtcatattgcctaaagcaataccctgtatgattacccaccttattagaaggatacagaaagttgcaaagtaaaataacagataaaccagattatactaaccagaaggccaaagtagctgtactatagtaggcaaagtagattttattgcaagagcatcattaaaaataaagatatttcataatgagtatgaaatgtatatgcagtaaaaattattacctcaaaatatacaagtaaatatgcttatgttttatatcgagattatatatttttatatatatgtataaatataactaaatatgtgtagtgaaaccacagataaaaaggaaatgctttatattaccttttccacttctcagaaaggcaaggattgaaaaataatatatttatatatgtatgagggacataataggaagccatgcttagccaacttttaaagagaaatttattggctacatttacaaactgatttgatttgtaggttttacttagaaagtgcatattcatattatcctgaaagatattttttttctataattgaaaaggtgatcctctttgattcagcatataggtttggaataaatttatccagaaaatttctatttaagcatacagacccatccctcagacaatggaatgcgttaggtccccatcagattctcacattcagttagttccaactttaccttccagatatcagtgtatagtcccacattctcccgaagcatgtgaaatattataaaatgcaatgtctttctaatcttttcttatcatggtttggttttgagaatgcactttttataaaggccattggagtctaaatctttggagaaaaataatttttttcaatctggagcagtgcttattactcttctttggagacttagacaactttgagaatataattaaagctaatagaaactcattcaagaaaaatagatgtacaaataatcacaaactatggaataatatattagaagttcaagaagttcatctattgacgagattatgagtgcctgatctttgtgtttttgttggtccatttcatcagccccttagaaaagaaaaaacatgttgtgcaaagtttagagcaagctactatttaaaaatagtagctctaattttacttatggatcttatttaatgtgtaaatgcctggaggctaaaagcaatggaaaaaataaggacaaaaattatacctatgaaatacttctgtttttcaggaaattgtatttttataaaatgcagtttagaacaaatctcaacattatgactttattcaaaagaaagatttatagatttaccaattcttattcagagggagattgttcgggttatgtattattatagaagttgaaaaaaagcatgagaatacatcatttctcaataaacttagttatcaatttatttttcagtaaaataacatgagaatttacaagtatgagaaactgttccatctgtgcaactctaccaactatccccaccagaagaggattatctatgtagccttaatagatgatattttcaaaaaaattgagagactgagctataaagtaaatagctttatagtgttgtctcatttaagaactgctatatttattaaaaattcagaaaatacagaatataaagtagaccatgattattacctgcagttttcggatataacaactgtaatcatctgctgtatatcatttagatattttatgtatatttttaaaggtatcaaaacaacacatgtatggaagataactcagcattctgtttcaaagtcacattttaaatttctttaataagtgtctaaaatttacaaatgtaatacatactttctatggccattgaaacaaatacaaggaggttggaggaaattttaataaatattctgccagtttagctccatcactatcccctgaacatatgaaccatatcagcctgacatgtatgcttgcacatcttcctctgaattgacgctggcatttaaacaactacatacacatatggattactgtttttctaactgttcattttttaaaaaacgatttttaatatactatctactatttgtttttttcatcagaattcttctaggctaagatatatatatatatatatatatatatatatatatatatatatatatatatatatatatataactaatttttaccagtatattaaaacttagacttggttgaattccttaaaatgtatttatttctacaaggtagattcttaggagatgcgtttctgggtaagacactgcatacattttttagtttattttaatagatattgccagataatttctcatttttaaaggtttttacagtttccagagttataaatgaaagttatctccctaatcctataggttagaggactttaatattttcaatctggtggataaaaaccatgtggtattatgacattaattacaattttctgtctcctactgagattgagcaggtttcttttgtgtgtgagtcatttggttcatctcttctggaaataatttttcttctaaaaatatttttggtatttttcaataactgttttggttattttctttgagtcaaattatagatgtttattagatatttgaggtattattctttacatttgccatttttgtaggaaatatccctcacttcatcactttatttttttgtcattgtactttttttcaacttgtatataattaaatttgtaatttgaaggaaacctatacaatatttttctttcctagcccaagaatataaagattctcaaatattttaattctaactttctgcttgtctgttctgagtgtttgaaagcaatttaaatctctcttattttaaaagagtaccatattagtcattctaaaattattatatatcaataatgctatttacatttaccaatgtttttagctaattatttgccctccattttggattcagtattgttctagctgaaattcatcttttagtcatttgtttcttataatgtctaaaattattatcttgtttctttactcttactctaaattgctatttcaagtaaataaagaattctgggttgaatgttatttttcctgagcacttttaagataaccatatttacagaacaaaatggaaaattataaatattaatacttttaaaaataattcaactaaaataattggtgtgtaaggcgtattggaagttttataatttcctaattattaatattagggagtctgatgatattttttaattaattgagaaagaaagccttaatattattcaaagtcatggatgatttttgctttcataatggcttattaggtaattccaactaactccctaaaacaatagataaattgaaaaaattaaatggacaatatctgcttgaaattattgctagctaatgagatcgtaaataggagatctagcagaggagaaagattaggagaatataccaaatcctgagcaggaatataaaagcaaatgcatctttcagttttgtgtgttgcttggtttggacaactcacttccctcagccctggaaaacttgcagccattatcacttatgtatcaccgttttcccattcttttcagtttcttctagaatttctgttagatatatgctaaatggtctccatctatcttctgtagctattacaacccccttcttatttccatttcttctacattttattccagagtattttcttgtatattatccatgtaatgaattctttttaaaattatctttaatctacaaattattgtgaccattatttacagaagttttattttgttcttttccaaaatacttctttttgcttccatcatgtcatgttctgatttttatagtctacacattttaaatatttgtagtttcttttaggttgttcaatttttttctccttcttcatggacttccctttatagggttttattcatttgtgtggcttgtaattttttttattaagattttgtcatcagcaaggattgctttctgtgggagttcctttctctctgaatttatacataaggttaagtttgtataataccttcctggatcctaggagttttactagttgtgtaccaggctttttattgatttttcagctttgggtcttctactatgcataagtgtatgctctgtactcattcaagttgcagacctaggttcttgattttctaacaattctgtccagtttcatggctagatagccagcttctatgtggctttcgtaaagtactggatgtagttcttcctgtccccacttcacaactggggcaatcctccaagttcctagactttaggcaaggaggcacaattccaggctctcaccttgcatggctctgagtcccatctcctgttcctacatgtacaacaagcctcagaactcagttcttcaggaccttatttgggtttgataggactgtggctcactttggcctcagctgtgactgtttgacattttaaatttcctctatatatttggacttgcagattcgagctcagttatgcatttagctaaaaagaaaaatagtctatggatttgaagtagaaaaatggaagttttcccatatcatcttagataggcatatcgacctgatgttttccctaagaagctcctcagcctctcataaaaatacgctccttatccttcacatgccctccactttttcctgagtaaatataaatgtaggttctctgtgcaactatatataatatcattataacctaataactcatgacatgtattctagtagtaacatttttccatgcctaatatttattgtttacatattaaattaagcaatcatccataaatattaatggtttatatactgtttaacattttattcatttttgttattactgaatactaccaacatgtgataataaaacaaacagaagatcatatatataagtgtacaaaatttcttcattctttcaactactatttattgaatggctgctatattccaagcactctaataggcactttaaatcactgaataaaacagaagattttttatgttattttcttcatgtcggtgaaaaagaatggccatttctcttgccttgggaagtgacatcgagcagaagtagtaggagccatccatgcagagacagtttagaaccccctctttcatagaatgaaagcttgacctacaatccaatccttcactggcattttcatgttgatgagtggtaataaacattaaattgtctctggtatttttacagcttagcaaatggagtacctttgggactctggaagttatgcctcagaatgaatcggaaacacagatgttctcggtggtgacagaagacgattgtgaaattcttaaaatcccagcaaagggatatgcaaagataaaggaggtaagatgatatctaatattttatataaacaaaaattgggcataaactcaagctacattttgattctctagacaaagacagctatatctgttttatttttaaattttaatttaacctagagaccataaaaatgttatttgacaaaaatcacttaagagtgctggtgataggtaggtgaggtgtaaacaaaggtctcaatgaatatatttcaggtaatttttaaataccctttggcttttcattaattttaaactcattaatttattcattcattcactcactcattcattcaacaaatatgtgttttgcatgtccgcagcatgtcatatgctaagaatactagaataataagacagataatagtactgctgctttcccagtctctgtagtctactttaaaaggaaaaatacttgaatgtgattgccatgatatttcataattacaacagatatcaaactcagagctgcatgaataagtgataacaacttattctgattccctaattctgcgtttttaagataacttcatttacttaaagtttaataatttattctcttctaatcaaatccaaattttttcttgactcctatttttcctcctttggatatcagaagaagtttgtataaataatgagattgaggctaggggcggtggctcatgcctgtaatctcagcactttgggaggccgaggagggtgtatcacctgaggtggggagttcgagccagcctgaccaacatggagaaaccccttctctactaaaaagacaaaattagccgggcttggtggcacatccctgtaatcccagcactttaggagaccaaggcaggcagatcagctgaggtcgagagttcgagaccagcctgaccaacatggagaaaccctgtctctactgaaaatacaaaattagccggacatggtggtgcatgcctgtaatcccagctactcgggaggctgaggcaggagaattgcttgaacccaggaagtggagtttgtggtgaggaaagatcgcaccattgcactccagcctgggcaacaagagtgaaactccgtctcaaaaataaataaataaataaaaaataatgggattcaaaggtttccatgatcctgctgtttcatctttttttgaatgagcttaagccaggtgcaggtcctgcagaaagctggcataagccatggttcagtgctcatgtggagtggtgttgagaagacatccatcttcttgggtctccagtggtggggaattcttgtgatttagtggtcccagtgtcagtagtgcaggtaattctctcagaattcaacgttattccaaatccctgatgtttatttgttttgattttcagagtggctagctttaacaaaaaattctttatgttttgtttttatttcccaaatatcagtaccagttacttgattttatcaaacacaactttttagtttaatcttgactatgacagggtttttaaaaacttctaaaacatttatagaagtataataaattatgaaaggtgagcaaatataattttagtaagtagatctgaagattaacattttaatatgtctatgtggccatagagtgatgctcagataaaattcaaatgtattctatactaacttatattcatatggcctttattttacttctctcaccatttatctatttgctatttctttgattttaaattgcctgttattaaaaatttgataatgacattctgttttaggaaaaaataaaacttgaaaatatgcaaaagttgaaattaatccgtatgtgtccttattatgaggaatggcctactttatccatatatgagctaattgcactccttaaatggaaaaaatttcctccaggtcatggtaagtttaatgcaatttagatcattttgtttgcattctgttatattattggaattgaaattcttcatagttgtaatattttatacaatatttcttcatataaatattctctaatttatttgataataacatttgaattggacatttagattatttcctgctttttattaaaaatgatactgtactggcttgaagtgtggtctcaggactaaccttacttttaacatctctctctactccctttaactgttccgcacttgctccaccctgacagttactataagggccaaactgaaaaggataaatactagagggtatagccactcacacaggagaaaaggaaaaaaaccatttttttcttttcctttttcctgggtggataactatttaagcagcaagtttgctaatctgtacttgtgctacatatattagccatggaaaaaaataattatggagaatgagtgaggcctagataagagaaagcagcagtgaagcacctacattttcaatattcagcatagcaaggatgcacggatttcctggattatgtgtacacaaaaagtgtaggtggtattgagtcattttgcatgatttgtccatctatgaaagccaatttaacaagggttgctaaaccaagaggaactgtggtaggatgggccagagctttaggtctcttttggtaaggaaacacaattgctacatgagagacagccacagataacagagagaggatggcgacctcgactctctttcctcacagccagtgaaggagccagaacttagattataatggaagaggaagtgtttgaaagaaatacttctaccccaagtctgcaaagccacaattatagtgagggacatttttaatttaagtttgagattaaagttctaaaacgaatgaatctgattggtaaattctagacagctactattttaataataaaaacatggcagactagttatgaaatctggctaaggtatcctttgagggaaacactgtaacacaggaaaacgaggttcagcataccaggagttcttttactgaaaaaaagtaaatatcattagaggcaagtttatgctttaaaaagcagggatactctaataaaccacttaaatttggtgagaatctaaaacctttctcgtatttcttccaaatttccttctactgcttgcatttatattttatttatcatgtttttgagatgtagcatttaatccatgtttagtcaaataactatttttgctcataaatttgaatatttgtaatattatgtttttgtttatgacatttttttcctaattagttataaatggcatttttttaaccaaaagtacaaatggaaggcaagtagtaaactgacttgtaaaaaatcgggaattgaatatttctaaattccccatgtttattacatagaaacagatgagcatcccagaaccagtttgatacctccaggtcccagtgattcaagtacctgtaatgatgatgcctttttgttccttcattcatccttcactggtctcttttgttttggacaattttttctaacgtagcatattaattcttataataatttttcaccatatttgctatttttcatggttgctttattttttatggttgttttggatttgtcatggttttgtcacaggtttcccactttttatcagaaatatcaaattttgatccttgcctctcttccatgcttttaataaaaatataatatccaatctttgcccatctatcattatattaatatttttgaggtgattagaaaagaggaaagagaccatcataaagatattttaaattaggggatccaaaagaatttgaaatttggaaaggggagaatgattatgtgttttaatatgtttgattactaatgataatctgtctcttgatctaaaatatcaatcaaaagtactaaaattttgcatcaaagagctaaaaaggtactgagacagttaacatactgtttcctagactaatattgaattcaagttcttttttgtaaatatcttgaaaaataaacggtggtgtttgttaaactaccgatagcattggacaatctgtgagtctattgaataagtcaaaataatattgttttctcacctattcccaaacatataaatgtgtggtactttcatagttttagaaaatatttaacctccttagagaagaatgacaatttcatctgataatcatcaaagccctatgagttctgaaagactgtagtttttataaataaatatacctacgtgaagaataagtcctgtcaaattcatctaattttcttttatggtagtgacaaacttgatatatcaaagagaggaattggattataatacttcctgactgtttagtcaagatttagtttgaatttttatcagagaatgtagagaatgtagctcaaattacacttttattatctggtttgaaaattagcagtagtatgatttccaagcataattatgtgtgttttgatcttattttaagaatgtacagtggatagggtttcagagggatttagttaattattcaaaagcttgatagagtttaggattaatccttggcaatcaatgaaataagtaaagcttgtatctgactctatttgctttgttaacttcttacatcttcctacttttgcttcatatgccaagggaaccttattataatgaatatgtacagtgttgcttataatttgggtgtgtccagtttatatcacatcggctaaagtcttcccagttgttattctttcaagatgtggccaacttgaaagcgacaaccagcttaggtcactaatcaacctgttcccatgtgtatcatggatataagaaaaaatggtaaactgacttggcaaacatttaactatttatgcatattttgttgttttcttgcttatgtcagtatgcccccatctttctccaggtaggatttgatatagcaaacatgttaattggaaaaactaaaaaaattacagcaacatatttagtgcagaaagataaagtatgtgaaaatcataataataacagtaatagtcaaaattatatctagttatctcaaaccaaatgtggagtgtttcagtcacaaaatacataggctctacatcccttcaattttttgacatcaatctcttccagttcaatttactcttcagggaatcaaaagtcttagtcccatgagacactcttgagcatcccagaaccggtttgatacctcgaggtgccagtgattcaagtacctgtgatggtgatgcctttttattccttcattcatccttcactggtctcttttgtcttggacaatattttctagtgtagcatattaattcttttaataatttttcaccatatttgttactttttatggttgctttaggtcttaccatataaatttcaatttagcagaatctacttcagatttttactaacttaattccagttttaaatgtgactcatgtagctctatttccatttcctcctttatatgttattattattatacatattgcatctacatatgttacaaatttaacaatacattattattttatataaagttatgtctcaaaaacaaagaaaaaagagatcaaatatatatttatagggttcattatattagacatcatatttaccatttctagtcatttttatttgttcctgtggacttgagttgtcatctgatatgctttccttagttcaatatcagttttctcccacctgctttcttatgctgctattggcaaatatattatatttctatatgttatagatccaacaacattatacacatattatttcacacaatcactctttatgagtaagagaagaatggataagaaatatgcatttctcctaccttttacaattacacatttacctttagtggtactttttgatttttcatgtggattcaaattactatctggggatgcttgtttgcagcctgaagaactttttttagtatttctttgagggagtatatgctagtaacaaatactgccaggttttcttgtactgagaatttcttcatttctcctttacttttgaaagacagctttgcagggtgtaggatttgaagctgaaattgggttattttgtgtaagttaaaaatgcaatcccactttcttctggcttctattgtttctgatgtgaagacagctgttaattttattgggattcacttataagtgacaaggcttttgcttgctggtttcaatattttctccttgtctttggcttaaagaagttttaccataatgtgtctgtttgcttattttcttacctagtactagaattttctgtcacatactttatagccctatttattactaatctctctgtttctgactctctcatatattgttagctatgctaatcagttttaaagtttttcttgttattcacccacttagaaatagtctatgtcctctcattgttattcaggtaaaatgcaaaatctttaatgtagtttgaaaggacatttgtatctgggccatacctatatctcaaagttttaattttaataattcttctctttttgttcatgtttctgccaacctggacttttattagttcttctagtgtcactatcgccattgagggcttttacacatgttgttccttcttcctggagaagttacttacccctcatttcagtatatttactattgttaagataatgttttctggaccaattgagattctattgctctttcttgcttgcagagatgcctctttgtctctctgggggtcaagaaatattttctgctaaagagcagatactaaatattagctttgtaggtcatatagtgcctctgttacatatccgcctccttcttctttttaatgcctttaacagtgtaagaatcacccttagttgtagtgttataaaaaaaaatgggccttgggtcagatttggtccgcggtctaaagttttccaactcctgtcctatcttattttgttaatcgccttattttttggggtgagggggcacaggggacaaggtctcattatattatccaggctggactcaaactcctgggctcaagtgatcattcaacctcagccattcgagtagctgagactaaaggcacatgccaccatgcctggctttccttgtattatcttaacactcattatgctgtgtcataattaatagcttaagggtcaatttgtccactagacttaaaatttctttggaatggaaccatcttattttttagtacccaacaaatatctagaatttgcaagcccttgaaaatattgttgatgagtgaatgaatattttgatgtcagtgtttacccttagaccaaagttatgacttttttcttccaaaagaaaataatttaactctttgctgctcagtacatctgggttgtattaacatttggcattaattctctctgtttgaggaaaatgctgtcattgattcaatcttaaaatatattaatacatttattgataaatctcctgattaaaacacaagctattgctttgctatctttgagtagatgttttacagaattgcatcgttgcaataaatcaaccattaataatgctgaaaggctatactgtcttaaactcacaatcctgagagaataaaggcaatttggatttaaggtgaggttaaataaggaaaacattagcacggcattaaggacagcaatagttaaagaagtttgaaagtctgttctcttcagtgaatcaccaagagtaaaagatttgtagaatctatcaactaatttttatttttggtcatcatgtttaattctcagtatgcatgcggcaagctttctactacatggggtgtgagaaatggaatgatcactgataaatgcaattcaagtataatttccctccttcttattaagtttgtcatcatatgtattgttcttattaatacaactgtaagaaaaaattttggtgaatgatgaatactgtagattatatggctcaatgcctcttccaagcacttctaaccaacctgtgaaagctaaaaacagctaaagactacatgttctagaatcctttgtaaaagttttaattttgattgtggcctccattctgcccagtatatatttctctgcagtatctggaagaagtcaggagcagctctccttgcaaccatggtgatgagcatggtggttctaaagttcatcccctgtttcacacgtgatgagtggcacagagcagcaggagtgaggtttcctttagaagagctctgtgttgtgagtgggcatttccgctggctactctattttcttgctctatagtattgaattctagttttatggccctactagagcttcctaacaccctctgataaacgactttttatttaagttagatcgcaagagtctgctgtctgtacctaggaacaaagggctgcgcactgggtgttcattctaccaatggtctcctttgtgaatacctagttttttcaacattttttcatttcaaaaataaatttttttcataagaaatatgaaatttgtctcttcatatttttaacatctgtgtacagaacaccatgctagttgcttttgttgtggcaatgaaaagaaatacatttttaaatcacttaaagtcaggccggacacagtggctcacacccatatcctggcactttgggaggctgaggtgggctgaccacctgaggtcaggagctcaagaccagcctggacaacatgatgaaaccacgtctctgctaaaagaacaaaaattagccaggcacagtggcaggcgcttgtaatcccagctacctaggaggctgaggcaggagaatctcttgaaccaggaggctgaggttgcagtgagccgagatcgtgctgctgcactccagcctgggtgacagagcaagactccatctcaaaaaacaaaataaaataaaatcacttaaagtcaaatgcttcagtaactacactgtactccttactatgtaggacagtttgttgatctcaaagatttaataattagaaaaatacaaaaagtatgatttttaaacaaatgagatagatcaaaatatgatgtcttaaaatgattttcactatctcatggacatatatattatctaacataataaatatcaacacacacagtggaaactgaataggagagaggattttttggatatggtttaacccaaagtaggactgataatgtgaggcaggaaaaatagcataagccaatatatggttttcagatcttgctttagaatagttgatcaaacagcccaatttaatcagatgcatattcatgaacattgggagatcagtcagactttctgtagtctcaggcattttaaataccatattcatatgcttgggctttaacttacagataatgtgacatcattaaaggttttgaataacagaagagacctgaaaaagtcaaagttttaggggaatagcagagcaatatgagtgatagttgaaaggagagaggtactagaaaaccagaacaattaggagtctattttggtagtaccagaggcaaagagatgagaggcaatggagataagaagtagtggtgacagtaataatggaaataaattaatatgaggaatgttttcattatttgggagtattgtatagaatagatcttttcaaatacatttccacttctttgcaatgctgacagtctatacatgttggggatgttctggtttttcagatctctaccagagtgctctgttgctgcacagatgcatatgtctgtggatgtcagtttaaacacacatcagacactgagaacggattctcaagcatgggttgaaagggacctgtgctctcacccaccacctgcagcattagaacacacatttcctggatttctcactgtctccactccaaagtcttttgtgagtgcaggccactatttatatatgttcagaggagagttgcttttattttcctacccagagcccaagcataaagatagtttccagaatgactcatttcatgtgtggaaagatatttttaattcacattttcattgatagtcttcattgacattattttccctttactcttacttttgtcattaaaactcaagcactttgactactgccatctgcaaatgttcccaaggcttcttatgggcctgtttaccacttttttcagctttatctgtaatatatatttttttactatgaaaggatttatggtgatattgatcatctaaaggtacaaattcagaatatatgtattttattgttttctaaataatatttattaagattacttaaatataatccagtatctcaacatagacttttctgtgacaatttttttttacaattcaagaatcttcaatttatttgccatgaagcttctttttttataactgtttacttatgatttcatagtatacctttttgctagagtaataattagtaatagaaatgtgtgatggctatgtaaaatttaatgatttcattaacagtctctgaaaagagcttctaatattattaccagagaagctttaataatttacctcataactattatggctagaaatgtcattaaaatataatgttatagtataacaatgcactacagaatcactgattttgttttcaatcagttttgactttgacaaagatatttatatctatagaatacttcaaacatactttgtagaaagtatatagtttaatttcttactcagaatttagccttctgattttattaataatatgataaatgtgaacagtatattagttatgtaaagttaaagtactgcttatttaaataattatccagctgctagataataattaaattaaaataaattaagaatttatttaattaattcaaatccctcagaagtagataagataaaattaaacaccttttaataatggaacactcatctattcaaattccccatgagtagatggagcttttcatcagtaacccaggcaactactgaagctctttatagagctcttttctctacctctttctacttctcacaaatgaccattgcttctttattttgtcacaacataaactatatttcctattattgcaattaacttttagtattgtgtctcctgacatttagaaggaaagttggatttctcttcacctaaaaaataaaattgcataatttcattttctcacatttgaagcaaacttaatatataaaaataaatttgaaacttttttctctaagcaaaccaaatatgtgaacatttaaatctagagaaatgctaaattataaatactattcattttaataaaagtaatttctactaaaatttccaaagtagaacttttaaaaatgcgaactcttatgtttcgctatgaatattatttataaccaaactgttaacaatgattattgctgcttggtgctattgattgtcttttttcctgtttttctgtatattctagacattctataataagtacatatgtttatagcaaaataaataggtacaattataatacaatttgatttctaaaaacctaaaacaatatttttaataaagaagcaattcgtattggatgttgtgatccaccattcctgtcttctacccataggagtgcattagcataagtccttgccatcttagatttgacagttttcatgaactttggcaatacatacttttgggaatgccttctgcatggaaagtttcttcacattcggagggataaaatgaacaaagatagagcccaaaataatagaagtagtcagttaggtatgtaggggagggagaaagggggaagaagtgaaaatagaaaagaggttcttacttgcttccaaattctaaggccaggtcattagtgtgtaaaagtaaataaggccaaagggtttctttgtgaatggtgacatcttgagtatgtctaacaagaggacataaagaagcaggattgactgttgcaaaagtaattagtatctatatatatgtctatataatttggtatatatatatacacatatatatacatatatatgtgtgtgtgtgtctatataatttggtaatgctgtcgtgaccaatgaccactgaattcatttcctttgtatatctgatgtctataaaaagagaaataagactttaaatcataaaacaggctataattcataaagtatcatggtgtaataatatatggtttgaggaagtatcttaggctgacacttacagaaatataatgcaagccacatatatcattttaaattttctagcacatacatttaaaaagtaaaaaataaggccagcgtggtggctcacgcctgtaatcctagcactttgggaggccgaggcgggcggatcacgaagtcgggaaatcaaggccatcctagctaacatggtgaaaccccttctctactaaaaatacaaacaaaaattggccgggcttggtggcgggtgcctgtagtcccagctactccggaggctgaggcaggagaatggcgtgaaccagagaggtggagcttgcagtgagccgagattgtgccactgcagtccagcctgggtccgtctcaaaaaaaaaaaaaaaaaaaaaaggaaaaaattaaataatatattttatgtaacacatacacataactaatttaatatgtgaccaacataaaaattactaattagacactttatacctttttcatattttgttttcatattaagtcttcaaaatccagtgttattgtacacttacagcgtatctctatttgatcttgccacattttaaatgctcaatagctacatgtggctagcggctaccctatgggatagcacagtcgtagaacatgcaatactctttctgatactgtaaaacagaaaaagaggcaaaaatattggcataacagatatacgatatgaatttttaaatctgtgtaaagattaactattatttctttttaaaatatcttataaatcactttaataataacttcctaaaaagtggctagagctaagagagtgaaccatgtcaataaaggtttgtttttcttattctgacgtttgaatgtccttaatttgtctgtaatcacacatttacagatgcatttgtgagaatgtggggtgtgtgtgtgtgtgtgtgattatctcaagaaaatgaaaacatatttacctgtaatattttaattttcattttaaaataaactatgttgcactaataaatctgttgagataccaggattatgaattaaatatcttagatcttaatctttatggatgctaatgggcctcatgaagtgatatttatatctctatattctatctagaattctatattttatctagaattctatattctatatattctccctacatattctatatatctatatctatattaagatccttattaatatagacattaacatattaataagagctttattattaatatagatttgtataagctgagctgtattttaaatacatcaggaaacaatatttacagacataataattatttgagaaagtaattttcaaattttttgtaaatctgatttttattattgttattgtaactacattgcttttttttattataaaggtaattttatattccacaaagttttaccccacttgcaaatagactatgcatgtttatagtttaaaaattatatagattcatggtatcataaatttgaaatcttaagtattcccctcccctcaagaaaatagtattaactgcttaggttcccagggcaaagcgcgatggaagacttaaggtatccttctctgcttctgaaaatgaggggctactcctcaccccatgatcactacaccctgacccattgaacaacataaatggatattcctttagcttcaaatgtgccttggtttcttttttccctcttttttttttttttgagatggagcctctcactgtcgcccaggctggagtacagtggagcaatcttggctcactgcaacctacacctcccgggttcaagtcattatcctgcttcagcctcctgagtagccaggattacaggctcccaccatgaagcctggctaattttttgtagttttagtagagatagggtttcaccgtgttggccaggctggtctcgaactcctgaccttgtgatttgccttcctcggcctcccaaagtgctgggattacagatgtgagccaccatgcccggcccaaatgtgccttggtttctttgctttgtccagaagattgggtaagggaaaaatcagcatttattgaacatctgctctgtgtcagctactttctagttactttcacacacattgtctcatttacttctcaaaacctctatcagaaaagtatatttgctttattaatacagaaactcaatctcaaacgtttaccattccaagattagacttttggtaaatgtcatgtttgaaatccagaactgataaatgtgaaaataaatcttctttctgttacattatgaaatttcttcaagaggttttctagtgtttggaaaagtctgaagcaactgcctgtgggtttgcagaggtaagagtatcacgacaccagtcagtacaaaaatctgggttttatttattcatttgtaaactcaagccagttctctattccactttttccaattatttgcttttgagagtctcaggattatccttccttcctctccttccacattttctcccctgtcccttctcctggccatgcttctctagtcccgacggtcttgtttagatcacaatgcggtttgtagattttccttcactctctctttcagaaaaaaatgccaaaatggtgttttaagaagcttttattgctgtaataaacagaaagaaatagacatatggttaaaaagctcctcacagcattccatcttctcctcctgttcacatagatcttccttagttttcatgtaaatgaaataagtctttgggaacatgcagtcctgaattagatccaaatgcatttcccagaaaatcatagattaaatggattttggattgttaatttgataagttaattggattccttgtttgttggagaagaccagaatgagggctgaaaactcagtccaaatacgagacagagtgagtaatagctatgaaaattgtcccagatcatttgtcacctgggtgtatgttagaaaaaggtactactttctcatggcagatgtggccctatgctagggaacacatagtggtaggatcatgagctggatttcagccacaccacaccctgcagccaggtgtccttttgcagtgaacaacctgcaaaatcatgtatatgcagtgatcttccatctctctgttcttttctccttccacatataacattctgaaatcatatacttgagcttggattataaatagggccaatggcctagaaatatggagaaaaaaatgaaaaatataatatagtgaaagggaaacatgaagagttttcttagcccattggacacttggcttaacctggcaaatgttaacatgtggagaacatatgcaaatcagttatccataagtcagcatcacttgcagtttaaaaaatataaatatgatatcaaaactcaatattatagttttatgaattataaagtatttttaaatattttcaaattgattttattaatgttattctcagaaatggaaactattttaacaaaatatttgtgtccatgtatgtagccacagagattagacacagacacagcatgctataatgacaatgaattatatctcgatcaataagtatttacaatatataaaaccccaaaagtctggagagtcaccagaacgagtacctgttactactgattttaaaatccatattgaaaaactttaaaaaatctaaagttatgcattgttcaggtagaaactagacacactaacttctaagaagctaaaattttgtagctatactggtacgttagggccactagctggtcacttaattgaagacattagaaaatcatataaaatgacatatatagcttaagcattttattttaattgaaagtatttatcatggagtcagacacaatggatagtgcttgtagtcccagctactcaggaggccaaggtgggaagattattagatgtatatgtgtgtgatacacacacacatatacacacacattctatttccaatgtttggagggtgaaggcctcttattttagtatggttccactgattggagatctgaatttttttgtgtacttatgaattttagcataaattcatttaaagagggacaacaaataaaatcttttgtgaagactaaaaatttcttttgtacaatacaaaagatgaaacaaaatgttggttctttgaaaaaataaataaaattgatagaccattggcatgattaaccaagaaaagaagagagaaaatccaaataaccccactaagaaacaaaacaggagatattacaactgacaccactgaaatacagaagatcactcaaggctactatgaacacctttacatacataaactagaagacctagaagagatggataaattcctggaaaaaatacaaccctcctagcttaaatcaggaagaattagataccctgaacagactaataacaagcagcaagattgaaatggtaatttaaaaattgccaacaaaaaaagtccaggaccagatggattcacagcagaattctaccaaacattcaaagaattggtactaatccttttgaaacaataccacaagatagagaaagaaagaaccctccttaatttattttatgaagccagcatcaccctaataccaaaaccaggaaaagacataacccaaaaagaaaactacagaccaatagccttgatgaacacagatgctaaaatccttaataaaatatttgctaactaaatccaacaacatatcaaaaagataatctgccatgataacgtgggtttcataccaaagatgcagggatagtttagcatatgcaagtcaataaatgtaatacaccatataaacagaacgcaagtcaataaatgtgatacaccacataaacagaattaaaaacaaaaatcacaactaagagcagaactgaaggaaatagagacacaaaaaacccttcaaaaaatcaatgaatccaggacctggttttttgaaaagatcaacaaaagtgatagaccactagcaagactgatgaagaaaagagagaagaatcaaatagaggaaataaaaaatgataaaggggatatcaccaccaatcccacagaaatacaaactaccatcagagaataatataaacacctctatgcaaataaactagaaaatctagaagaaatggataaattcctcgacacatatacccgcccaagattaaaccaggaagaatttgaatctctgaatagaccaataacaggctctgaaattgaggcagtaattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggcaagcatcatcctgataccaaagcctggcagagacacaacaaaaaaagagaattttagaccaatatccctgatgaacatcgaagcaaaaatcctcaataaaatactggcaaactgaatccagcagcacatcaaaaagcttatccaacatgatcaagtgggcttcatcgctgggatgcaaggctggttcaacatatgcaaatcaatgaacgtaatccagcatagaaacagaaccaattacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgctgatgacatgattgtatatttagaaaaccccatcatctcagcccaaaatctccttaagctgataggcaacttcagcaaagtctcaggttacaaaatcaatgtgcaaaaatcacaagcattcttatacaccagcaacagacaaacagagagccaaatcatgagtaaactcccaatcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgctatccccatcaagctaccaatgattttcttcacagaattggaaaaaactactttaaagttcatatggagccaaaaaagagcctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctacaaacatctgatctttgacaaatctgagaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctggaagaaaacctaggcaataccattcaggacataggcatgggcaaggtcttcatgtctaaaacacaaaaagcaatgacaacaaaagccaaaattgacaaatgggatctaattaactaaagagcttctgcacagcaaaagaaactaccatcagagtgaacaggcaacctacagaatgggagaaaatttttgcaatctactgatctgacaaagagctaatatccagaatctacaatgaactcaaacaaatttacaagaaaaaaaataaacaaccccatcaacaagtgggcgaaggatatgaacagacacttctcaaaagaagatattaaacagccaaaagacacatgaaaaaatgctcaccatcactggccatcagagaaatgcaaatcaaaaccacaatgagatatcatctcacaccagttagaatgtcgatcattaaaaagtcaggaaacaacaggtgctggagaggatatggataaataggaacacttttacacattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaacaaacccaaatgtccaacaatgatagactggattaagaaaatgtggcgcatatacaccatggaatactatgcagccataaaaaatgatgagttcatgtcctttgtagagacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttgtggggtggggtgaggggggagagatagcattaggagatatacctaatgttaagtgatgagttaatgggtgcagcacaccaacatggcacatgtatacatatgtaacaaacctgcaccttgtgcaaatgtaccctagaacttaaagtataataaaaataaataaataaataaaaatcacataatcatttcaatagatgcagaaaaagcattcaacaaaatccagcattactttattattaaaactctcagcaatgtcggcaaacaagggacatatcttaatgtaataaaagccatgtatgacaaacccacagccaacacaatactgaatgggaaaaagttgaaaacattccttctgagaactggaacaagagaaggatgcccactcccaccactcctcttcaacatagtactggaaatccttatcagagcaatcaagagaaagaaataaagggcatccaaattggtaaagaggaagtcaaactgccactgtttgctaacaagatgattgtttaccttgaaaaccctaaggattcctccagaaagctcctagaactgatataagaattcataagtttctgggtacaagattaatgtgcacaaatcagtagctcttctatacaccaacaatgactaagtgaagaataaaatcgagaactcaacaccttttacaatagctgcaaaaaaagaaaaaatacttaagaatatacctaaccaagaagttgaaagacctctacaaggaaaactaccaaacactgctgaaagaaataataggtgacatgaacaaatggaaacaaatcccatgctcatggatgggtagaactgatattgtgaaaatgaccatattgccaaaaacaatctacaaatcaatgcacttcccatcaaaataccaccatcattcttcagagaattagaaaaaacaattctaaaattgatgtggaaccaaaaaagtgcccacatagccaaagcaagattaagcaaaaagaagaaatctgaggcatcacactacctgatttcaaactatactataaggccatagtcaccaaaacagcatgggattggtataaaaataggcacatagacccatggaacagaatagagaacacagaaataaacccaagtacttacagccaactgaacttcaacaaagcaaacgaaaacataaagtagggaaaggaaccctcttcaacaaatggtgttgggataattggcaagccacatgtaggagaattaaactggatcctcatctctcaccttatacacaaatcaactcaaaatggattaaagacataaacctaagacttgaaactataaaaattctagatgataacatcaggaaaacccttctagtcattggcttaaacaaggatttcatgaccaagaacccaaaagcaaatgcagtaaaaacaaagataaatagctcggacctaattaaactaaagagcatttgcacagcaaaaggaacagtcagcagagtaaacagacaacccacagagtgggagaaaatcttcacaatctatgcatctgacaaaggactaatatccagaatctacaacaaactcaaatacaacagtaagaaaaaaaaccatcccatcaaaaagtggtctaaggacatgaatagacaattcccaaaagaagatatacaaatgtccaacaaacatatgaaaagatgctcaacatcactaatgataaaggaaatgcaaatcaaaacttcaatgcgataccacctcactcctgcaagagtagccataatcaaaaaatcaataaaacagtagatggtggtgtggctgcagggaacacttttatactgctggtgggagtgtaaactagtatagctgctatggaaaacagtgtggatattcctttaagaactaaatgtagaactaccatttgatccagaaatactgctactgggtatctactcagaagaaaataagttattattcgaaaaagatatttgcacacgcatgtttgtagcagcatgattcacaattgcaaaatcatggaaccaatccaaatgcccatcaatcaatgagtggataaagtagctgtgatgatggaatactgcacagtagtatatgatggaatactacacagccattaaaaggaatgagttaacagcatttgtagtgacctggatgagattgaagactattattctaagtgaggtaactcaggatggaaaaccaaacatcatatgttctcaccgatatgtcggaactaagctatgaggacacaaaggcataagaatgacacaatggactttggggatgtgggggaagagtgggaggggggtgagggatagaagactataaatatggtgcagtgtatactgcctgggtcatgggtgccccaaaatctcacaaatcaccactaaagaacttaatcatataaccaaataccacctgtacccaaataatttacggaaaataaaataaaagtcaatgtaccccaggatatgggggaacagaaaaaaatgtactcaataactatatctgaaataaataaatgacctaacctcaaaaataaataaaatgataggaaaaaataaaataatcgtaaaaatttgttttgtttttcccagactcttatctacatctaaatagaagatattattttgcaactcaatgtttagatctttctaacagattcgtcttagatttcataaaaacataagccctctcgaacataaaataattgttgttttaacatttgattaaatatgtacttacaatgcaaacgaaaattgtataaacagaatttggaacaaacacaactattgtgaagaacacaatttaactggcattaattgacgtacatgaggatattaaagtgtaggacactagctacaggtatttaatgggacataggcatgggtcatgctttgtagagtcaggttatttggcagatttgtaaaatggaatctggttaggaaatttttgctgaaaacttaagtgatcagaacttagcaagggctgcgtgcactggctcatgcctgtaatcccagcatgtttggaggctgaggcaggtggatcagctgaggctgggacttcaagaccagcctggacaacatggcgaagtgtcatctctactaaaaatacaaaaattagctgggcatggaggcacatgcctataatcccagctacttgggaggctgaggcaggagaatcgcttgaacctgggaggtggaggttgcagtgagccaagattgtgccattgcattccagcctgggcaaaagagtgaaactccgtctcaaaaaaaaaattatatatatatatatataacttagcaaggatattgcaagaaagcttcatggattctaaactaatatctttccattttaagtgatggcagtcaaactcaatgaagcaagagaaaaaataacaataaacaaaataatttattggtttatacaactaggaagttcaggcatttatctttcactaatgcctgtatccacaagttaaactaatctcactaggattgtattttccaatcctttgttcttttttcactttgcattagcttccttctccaggaagtttccccatgttatggcaaaagtagctacattgtctttacagccaacaagcgacattatctttatagccctgtgaaaaagtcccttttcctgattgttctaggaaaaatctgttatgacttactggctggagttgggttacatgcacacaatgaacaatttacttgggccaggggatggaatttgttgttcagttattgcttggtaacagacctgcccctaggaattggtaaagtcctttttggaaccctggactaccaagaggatgggtgtgtcacttgcaatttttaccaaaaaaatcatgtttcatccatctgggagtcagacatttcataatctttaaaatattcctgcagctctcagaattagttaataggactgtctccatttgagcttggatatgctttgtcttttttgtgtgattctatttcttctttcatgttgatatataatgtacatatttatggggtacatgtgatattttgacacatgcatacaatgtgtcatgatcaaatcagtgtatttaaaatatccataatctcaaacatttgttatttctttgtgttagaaacatttcaaatcttctcttccagctattttgaaatatacagtatattgttgttaactatagtcaccttactgtgatttggaacactagaatttgttccttttatgtaactataattttgtacccattaaccagtctctcttcaccctctcccctgacccttcctagcctctcatattgataattctactctgtacctccatgagatccacctttttagctcccacaaatgggtgagaacatgcaatatatgtctttatgtgcctgtcttatttcatttaatataccgacctctaattttatccatgttgctgcatatgacagcatttagttattttttatacctcaatcgtattctattatgtatgcatgccacattttctttatccattcatttcttgatggacatttacatagattccataacttggctattgtgaatagtgctaccttaagcactagggtgtaggtatccctttgaaatgctgattttcgttcttttgggtaagtagtcagtaataggattgctggatcatgtgatagttctaatttcagttttgaggaacctccatacatttttaaataatggctttatttatattcctaccaacaatgtataagacttcccctttttctgcattctcatcagcatttgttaattgtctttttgtaatagccattaaaactaggataatataatcggtttcttcttattaccaaatcatctctgcttctccatgccactgtatccccagttatacctgtcatttcttgcatttcttggtacctaatattttagctgtcttttattcgggtcaacatttaaattacagattttcctccaaatttctcagaggcagtaatgtttctagtgctattgctttgtgtatttctatttataactgccttcatatgatttcgggaaatataattccctgtgggaattttctagaattcctaaattgactcctgctcaagacttacgataagaaaagtttttgtagacttccataaacaaaactcatatctgtatatctgtagctgtgtgtctgtatctatatctttatcacttatacctatgaataactatatctacatataaatctgtatttatgtctatatataatcaatcatctcctggatagagtgatacctgtaagtgatttccatttttcaaaagcaagtcatacttctgttatcctctttcttctaaaagtaccatattgaaagtcctagccagggcaatcaggcaagaaaaaaaataaaataaaaggtgtccaaataggaaaagaataagtcaaactgtttctcttcatggatgaaatgattctgtacctagaaacccctaaaaactttgccaccagtccctgataaatgacttcagtagagtttcaagatacaaaatcaatgtacaaaaatcagtagcatttctatataccaataatgttcaagctgagaaccaaatcaagaatgcaatcccagacagatatggtggctcatacctataattccagcattttgggaggccaaagtgagaggatcacttgagcccaggagtgtatgaccagtcctggcaacatagtgagactccatctctacaaaaaagtttaaaaaattagcttggtgtggtggcacatgctatagtcccagcactcaggaagctgaggtgggaagatcacttgaccccaggaggtagagggtgcattgagctgtgatcatgccactgcactccagcctgggtgatagagtacaacactgtcttaaaaaaatgcaatcccatttacaatatccacacaaaaaaataaatacgtaggaagacatctaaccaaggaggtgaaagaaagacctctataaggaaaactacaaaacactactttagaaaatcatagatgacacaaacaaatggagaaacactccaccctcatagcttggaagaatcagtattgttaaaatggccatattgcccaaaacaatctacagttttaacactatttctatcaaatgaccaatgtcatttttcacataatttgaaataagcgattctaaaatttatgtggagctaaaaaagggcccaaatagccaatgcaattttaagcaaaaagaacaaagccagaggcatcacatgaccagacttcaaactgtactataaggctacagtaaccaaaacagcatggaactgtacaaaacagacacatggaccaatggaaaagaatagagaacctagaaaataagctacacatctgcaactgtcagtctttgataaagttgacaaaaataagcaatggtactgggatagctggctagccataagcagacaaaactggaccccttcttttcaccatatataaaaattaagtcgagatggagagaagactgaagcctaagacctcaaaatataagaaccctaggagaaaacctaggaaacagtattgtggacattggccttgggaaagaatttatggctaaatcctcaaaagcaattgcaacaaaaacaaaaattgacaagtgggacctaaattaaactaaaaagcttctgcacaacaaaagaaactatcaacagaataaacagaacctacagaatgggagaaaatattcacaaacaatatatccaacaaaggtctgatatctagaatctataagaaacttaaacaattcaacaagcaaaaaacaaaaaaactcacctaaaaagtagacaaaagacataaacagatgcttcttaaagaagacataaatgaagccaacaaacatgtaaaaatgctcaacatcactaattatcagagaaatgcaaatcaaaacaactaggagataccatctcccaccagtcagaatggctattattaaaaagtcaaaaaataacagatgctggtgaggctgcagagaaaaggaaatgcctgtccacagttggtgggaatgtaaattagtttagccactgtggaaagcagtgtgcagaattttcaaagaaaaaatggaactactaataaacccaacaatccaattattgagtatatatctaaaataaaataaatccttttagcaaaaggacacatgcacttgtatgttcattgcagtactattcacaatagcaaatatatgaaatcaatgtagttccccatcaacagtgtattagataaagaaaatgtggcacatatataccatgaaatagtatgcagctataaaaaagagcaaaatcatgtcatttgcagcaatatgaatgcagctggcggtcattaacctatgcaaattaacacaggaactgaaaccaaatactgcatgttctcacttgtaagtggaagctaaacattggacactcatggacataaaggtgccaactgtagacaatggggactaccagagtggggagggagagaggggagcaaggattgaaaaactaactattggatagtatgcttagtacctagctgacaggatcaattgtaccccaaaccacagcatcacgcgatatacctatgtaacaaacctgcatatatacccctgaatctaaaatgagagttgaaattatgaaaaagaaaatctctaatttaggcatttttcctctgaaaggtgcaaattgtaattttcgcaataaaacatatattcccctccccccaaaaataaaactactatatcgatattttgacataatctatttttaacaaaatgattccttgttgcaaggttgcaatgctttcattttaaccttttgtaacaattgtgtgtgagttacatatgcacacattctctattctcttggggcaattgctgcatgattagtttgatctctgaatattgccactcttgaatttgtgtcagtggcatttctatacattttgggtcccaaacacatgttaattcaaggcttcccaagctatgaattaatgacaaaaatgagctgatcttcagatcctgtgaaatatagtggggtttgacattgcttttataaagagagaaaactaagactctgctagagacaatctatcttttctgactacagcattcttatttcctattttaacttttttgcacttccatatgcaagtaagagccatatgagtaattaattttccataatatcatatattgattttttagctttaatgaaaatagtatttcgaggtgtttttttaaaaaacaaatctagcactttagaagactcagaaatttcagctaggaatattccataaaaatttttttctaaaaacaagagaaatattgggtcagtacagggcagccatgtcaaagacctgcatttctcttttggtcttagattgccaaacttcacaggagtttttaggaagatagagctatgagatttgtatttgctcccagaaaagttgggcatttacatgcagttagtattcaacgatatattgttctgcctaaatttcgcaaacgacatactctaagtgttttgaattattttcattatgtaattttggctgctttgtgagggtagtaccattttctgatgttacttaatattaatccactcttcactcagaaagatgggcaaggatttttactaaaataccatatacccaacttctgctttagaaaggataaagtgatattgaacttgaaaaggtttgatgctttttgcacatactacgttaatatttatttatccatttgtgtttgttggacaaacgttgttttagaaagaattgcagggacttatttggagaaaatatttgtcatagaatgtaaaatgtaaatcaaattggagttactatccaagaagaaatgacatgtgtctgaataatgcaatgagagttagtcaagtattttacacagaacaattttatgtgcttaagcagttacactcaagaagtactgtggtctcatatttattcatgccatttctcaaatatttaagacagtttcaaagagaagaactataatgtatgtaacttgaacaaattcttcaatagtgaaggaactatcaatagtttttaatgcatggaaccatagaatatcatttagcaaactgtctcaaccactcattctgtgtcctgcataacaagggaagtctttgagaagaaagtgatgtttttttcttcttctcaggaagatctgatacattacactgtgttcttatgttccctttactagatagaaaagaaaaagaaatatgcagccttttacaattacttgttcttaaatagaaagatatagaaaataagattaaatgcttatatgcatttaattttttaacattttacctactctttttacataaatgacagtaaggaaaacatgtcagcaacaaaaataatttttataatagtataccaaggcaaaaaattgtgtttacccccattttgtaccttgcattttctagtctaaactgtttttaccttgtgtgttcatcttagaagactgatcacagcagcctcttctggaatattggagagatccctccagagtaccaaagcacatgtaataatagcatgaatgctttacagtgcataagttacttgatttgattacattttcaagaagtagatgatgccaatgctttttttttctaattcagtataatatgggagctaaaactgacaaagataatataaaaaaagattatttatggatctaaaatgtgaatatcaatataaaaatcctaaaaattctatttggaaacataatctagcagcactttaaagaatggcacacccaaaacaaagttcatttattctaggaattcaataaagcatctcattttttaaaaaaaaagatattaccatttttcacttaaatataagtcaggggaggaaaatcatatccttatctttatggcagctaaaaaggatttgaggacagtttcatctattttttgacacacattcttaataaaataagaatagatgaaaactttcatgatatgataaagtgatctaaaaaaagaagtcagctacattcttacagtaaacaccagaaccattgccatgaaagtgatgagcttgctaacatttttaactaaaatagtaaatatgaaatagttaaagggggaggcagtattattattttttctcatgatattatcagatttgattatctatggaaagtcaatgacaaaatttttaagaaatataaaattaagtgaggtaaaatcttgcaagatgaatatgtacacatttattttataatagctctttgtcaattttaaaggaagaagaggttacatatatgatagcaccccaaatactaaatatctagaaaaaagttaccaagtaatataaaggtgctgtatgaaacaaacaagcaaaaaaccctcaaatgatgtaaaataagacagttcagacagaacttgttcttggataggaaaatgctttgctgcaaagatgtcttttatcactaaattcattagcccaacgtaaactttaaaaaatagtagtaggattttttggttgttatattgattctaatgtctacacggaaaatttaacaagcaaaagtacttagaaaatactttcaaaatactgagagattggaacataaatattttagtggacagattaattgaagaactaagtcagaaagaaaaaaatgagaatttggcatacaataaaaatattatttaaagagagtagggaaaatagtgtaacaaatattttgttttagacaaatagtgaatagaggtgaatatattccagctggatcacaaagctctatacaagctgtgataacactgctataaaaaattgacagatttattttcttacctctggtatctctgtttgtttgtgttgctaaaaaggaatacttgaagctaggtaatttattttaaaaatagagatttttttttttggctcatggttctgcaggccatacaagaagcatggtgcaggcatctacttggcttctggtgaggacctcaggttgtttccactcatgactgaaggcaaaagggaaccagagatcacatggtgagagacaaagcaaaagaataggaaggtgccaggctcatgtggaaactagcagagtgagaactcacgccttaccccgaaggatggcattaatctattcatgaggggtcagccctcatgacccaaaaacttcccattaagctcaaccttcaacattggaggtcaaatttcaacatgagttttggaggggtaaaatatccatagcagctgggaatgtaggttggttaatggtttcaaaatatagttagattgaaggaatatctcagcgtttgatagcacagtagggtgataatagtttataatttattgtatattttaaagtaggtagcagagaagatttggaatgttccaatcacaaaaaagaataaatgtttgaggtgatggatttcctaattaccttgatttgatcattacacaatttatgcatgtatcataatatcacatgatgtgccccatgaatatatacaattattgtgtattaataaaaaatttaaaaatcataaaataggtaaaaaacataaattgaaatattcatctcagagtaatatacttgatcttagccaaaaggctgagaagtgattcatctaagaataataaaaaattagtattctacatggcaaaaggtttaataaataaagcataacatacaaacagcaagctgtaatattgttgcatacataaaaaagaaattgttttgtcatatacaaatgactcttaccaacgaatagtaaaatctcaaggaggtgaagagaaatacaattagaatgaaaagatagtttctaaaaggaacaaaaattcctgtctaagtcaatttaacttataattttgaaaatatttagtttccattttttgcttatcacactggcaaatttttgaaattttattaatgtatgaaattttcctagaagttagaaaacaagaatcttatgtaatttaggtaggtgtgtcaattgatgcaacatgtttcaggactgatttaaccaaacctatgaaaagtaaaaatctgaatactaaaacagtgtgtgtctaaaagtttatactaccaatataaacacacttgtttgttcagaggttcaaagatagatgtacaataatttctattacactttttttttgcaataggaaacaagtggccatcaaggcacaggttaaataacttatgaaacattcacacagtgggagattgtagtcaatgaaaaagaatgaggaagatcataagcagacgtataaggatttccaatacatactgaaaaatcaaaaagtgccagaatgtgtgtagagattgattttagttgtgtatcgttatctagtgtatatctatttacaactcctatttatatacaagtattaatcgatatgaatttattattatataaatattcattatataatggaatgcattttagaatgtgacttaagaagtcacaagtactcaagtttgaagtctagttgtattatgtcctatttgtgaggccttagatgaattacataaacttctctaggtctcatttttcttctttgtaaaatggggataataatgatacttatctcagagggttgttataagaaatttttttgtgggggtgaactgtctgactagaaaatatcagttctatttatcttctcaaagaaatagccttggtttcattaattttctccattgatttttctctttcgttgatttctccttttttattatttaaattcttctgtttgtttggggtttaattcactcttatagtagcttaaggaagtagctcaagttgttgatttgagactttttttttattttctaagctagccatttaatgctgttctaagtactgcttttgatgtatacacacattttaatatattatctttttgttttcatctcactcaaaatgccttccagttttcctgtagatttctccttggcccatggtttacttgaaaatatcaattttcaagtaaatttttaaattttattgttatttgaaaatatttagttaccatttttctatatgttattattaattgtgtaattattttgtatttttatacattttttcatttagtggctttgaacttaattccattttggccaaagatcatgttttgtattatttgaattgccttaagtttatttagacttgtgttatggctcagaatagggtctgtgtcgataagtgttccattacacttttaaaaatgtgtattctggtatattggatgaggtattagtttttatcaaatattgggtggaaaaattttggaaattacatcttcaaatgcctacttcctcttttctgagtacactctaaatacataagattaggctcactgaatttgtcccatgtttcactgtttctctgttctaatatgtatgtgtatatacttgattttttttcttctctgtgtcttattttaggtgaatttctattggtgtgtcttcaagttcaccaatattttcttctgcagtgtctaatctactgtacatcagaaccattatattttttatatcagacattttagtttccatctctagaaatttaatttgactcattttatattatgtttttacttaaaatgctatttttttcactaacttcataaacattatgggatatgtgtttgataatgatttttatgtaattgtcttctgattctaatatctctcttatttctggttttctttcagttaattaatttttctctttattatagattatatacccatgcttctttgcatgctttgtaattttgcattggattccaagcatttaaattttactttgttgggtgctggattaaatatgtataagttttcttgagctttgttctgagacactgttaagtactcagcaacaattttatatgttcttgtcttgcttttaatctttctcaggcaggatcagaacagtgtttagtttaggtctaattttccccactgctgaggaaaaactgttctgcatactctgtccaatacaccatacgttttgaaggagcccctgcgtgcacatcagaggttgttccctctaataatgctggatgattattctcagttttgggtgctttcctcacatgcaaggatgctcacccagtacagcttcccagaaacgctggaggcagtcagtaaaggaattagatagaattaaagagaatgatactgaaataaaacctggaagactctcagaggaaggaaggagatggggagggggggcattggataattgcaataaatatagaaattgacacaatttcaaaatatatattgtatcaggctgaccaggcagaccctcagtcagatttcagagacaggaaggatagtcatggtaagtgatatgaatcacaccttagcatactctttctttggaagtagcatcttaacactatctttcatggaagactgatagccaaacttgtaagagttttaggagagctaaggctcatcagagaaaagaatgagcataatgaaataaacttggagcaagaaatttttaagcaacaaaaagaagagtaaataaaatcatgggttcattaaaatgagatcaacataatggtgtgtgtttaatgcaatactagtataaatcaaggaaggagaggatattaggagagaagtggcccctcaatgctgagagcacatgaaggatattgattgataatgtagcacttgatttcacatttagaataacactagttaccttcaacagagaagtttcaggaggatagtattacaggaggaagcaaggaagggggtaataattcaatgcttgatgtggaagtagaactggctaaaatggacaataaaactggggcccaataaaaggcaatgagcctcatattcccataggtatttttacattgttctaaatgccttgcctatagcagtaataaaaccaacaggtaatgaatacaattctcttctcctttgacaatacttgcagaaattttacctcacgtaaatggagtttagatgagtactcatagaataacctatatgaactttatttgaagaataaaaaatgaggaagcaaaaaagtaattttacctcattggaaaatttctactatacaaaaaagttacaggataaaagaacaaaactattactagaattgtgtagcaacaggggaaatatactttctttcagtaactaaatgtgttgttacagaaaagtaacatgtttttacctcaatttaagtttttcctctttaacatatattgattgaaaaataataatgctctataagaataaaattaacagtgaaagtagtagggtttgaattaaccattcaaaaaagcgtttctatatagctcataaatgttcattttatgcttagataagtgataaaggtaatgtgtatgagcctacataatttatttgatacccttgcattggattttgtcctaagttcttgatgttttaacaacaaaattttatcttttcccgtctctttttgagaatggcactattttaaaatgatctgaatttcaaaaagtatgtcccctagcttggaaacttctcagaataatgaattccaaaatcaagtacagacttcacaccatctgaacaaaaatatattgagtgtctgctgtttgcattgcatgacattgtgatagatgttcttttaactccaaaagagaaaaaattaaaaactgacttgaaacaaataccttttaactctcttatactagcttaactttttattgtttgccttatcaagttcattatatttcaggctttgttaaggacataactaattgtgttttgtgcatgataggagttgcatcctaatcacttaattacattaagtgatttacttttgtttctacagtttagttaaaacaagtaataagatacagtttttaagcttgaaaaataacttagattttcaatacctttataaaaattggctgaaaacattactgagactatcttcaatggtttctgcaaacacattatatgtgatgataattctggagtttctgacagaggcaaattattttgccacgagttaaaattatgtgccacctcccttagttcaatcattgattaacaggatttcatgtaatttaatggtcttatttttcaaaagaaagtgtgtgtatgtgcacgtgtgtgtgtgggggggcggctcagggtacatttagatgaagaagtcacaaaaaatacagtaactcaaaggttacaccttaaaacctatgtgtttatttattttttactgtgataaaaaacatgagacctatcctaacaaattttatgtgcacattacagcattatcaactgcaatcacaatgttgctcagcatatctctctaatattttcaccttgcataactgaaattttatattcattgcacagcaatttcccatttcaccttccctgcagcccctggcaaacaacattctattttctgctatcaatatggctattttagacacctcatattagtggaatcatgcagtatttgtcctcctgtgactggcttatttcacttagaataatattctcaaactgcatccatgttgcagaatatgagagtaattccttcttatttatagatgaattaccacattttatttacccattcttttgtcaatatcacttagtttccaccacctggccattgtgaataatgctacaacaggacatagtagttttttgagatcctgatttcaattcttttgaataaatatccagaagtaagaatgctgaatcacatgatagttctatttttaattttttgaagaatcttcatactgttttccataatagctgcaacatttcgcattatcaccaacagtatgcacgagtttcaatttcaacatgtccttaccaatttgtagttttctggtttgtgtttgtttgcttgtttgtttgattgtggccatcccaacacctgtaaggcaatatctctttgtgattttgatttgtgtttgtgtaataattagtgatactgaacatcttttcttatacctgttctacatttggatgtctttggagaaatatctattcaaatctcttgcccattttttaaagggttttttgatttttgctactgagttatagatgttccttatatattttgaatattaaccatttatcaggtatatagtctgcaaatattttctctcattccataggctgcctttttctctattgattatttcctttgctgcacaaaaactttttaatttgatataatctcatttgtctatttttgcttttttgtgcctgtgcttttggtgtcgtatccaagaaatcattgccaagaccaatgtcatcaggcttttttctttttctttttctttttttttttttttatactttaagttttagggtacatgtgcacattgtgcaggttagttacatatgtatacatgtgccatgctggtgtgctgcacccaccacctcgtcatctagccttaggtatatctcccaatgctatgcctccccgctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccagtttaatccatgtccctacaaaggacatgaactcatcattttttatggctgcatagtattccatggtgtaaatgtgccacattttcttaatccagtctatcattgttggacatttgggttgtttccaagtctttgctattgtgaataatgccgcaataaacatacgtgtgcatgtgtctttacagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctaacacctgttgtttcctgactttttaatgattgccattctaactggtgtgagatgatatctcatagtggttttgatttgcatttctctgatggccagtaatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctaggtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctattccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtacggccattttcacgatattgattcttcctacccatgagcatggaatgttcttccatttgtttgtatcctcttttatttccttgagcagtggtttgtagttcttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttggactgagacgatggggttttctagataaacaatcatgtcatctgcaaacagggacaatttgacttcctcttttcctaattgaataccctttatttccttctcctgcctgattgccctggccagaacttccaacactgtgttgaataggagtggtgagagagggcatctctgtcttgtgccagttttcaaagggaatgcttccagtttttgcccattcagtatgatattggctgtgggtttgccatagatagctcttattattttgaaatacgtcccatcaatacctaatttattgagagtttttagcatgaagggttgttgaattttgtcaaaggctttttctgcatctattgagataatcatgtggtttttgtctttggctctttttatatgctggattacatttattgatttgcctatattgaaccagccttgcatcccagggatgaagcccacttgatcatggtggataagctttttgatgtgctgctggattcggtttgccagtattttattgaggatttttgcatcaatgttcatcaaggatattgatctaaaattctcttttttggttgtgtctctgcccggctttggtatcagaatgatgctggcctcataaaatgagttagggaggattccctctttttctattgattggaataatttcagaaggaatggtaccagttcctccttgtacctctgatagaattcggctgtgaatccatctggtcctgggctctttttggttggtaaactattgattattgccccaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcagtggtgatatccactttatcattttttattgtgtctatttgattcttctctctttttttcttagtagtcttgctagcggtctatcaattttgttgatcctttcaaaaaaccagctcctggattcattgattttttgaagggttttttgtgtctctatttccttcagttctgctcggattttagttatttcttgccttctgctagcttttgaatgtgtttgctcttgcttttctagttcttttaattgtgatattagggtgtcaattttggatctttcttgctttctcttgtgggcattcagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgggcggctttgagtgagattcttaatcctgagttctagtttgatttcactgtggtctgagagatagtttgttataatttctgttcttttacatttgctgaggagagctttacttccaagtatgtggtcaattttggaataggtgtggtgtggtgctgaaaagaatgtatattctgttgatttggggtagagagttctgtagatgtctattaggtccgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttcaagtctgttttatcagagactaggattgcaacccctgcctttttttgttttccatttgcttggtagatcttcctccatccttttattttgagcccatgtgtgtctctgcatgtgagatgggtttcctgaatacaacacactgatgggtcttgactctttatccaacttgccagtctgtgtcttttaattggagcatttagtccatttacatttaaagtttatattgttatgtgtgaatctgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattgacccccactctcttctggcttgtagggtttctgccgagagatccgctgttagtctgatgggcttccctttgagggtaacccgacctttctctctggctgcccttaacattttttccttcatttcaactttggtgaatctgacaatgatgtgtcttggagttgcacttctcgaggaatatctttgtggcgttctctgtatttcctgaatctgaacgttggcctgccttgctagattggggaagttctcctggataatatcctgtagagtgttttccaacttggttccattctccccatcactttcaggtacaccaatcagacatagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcccgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacagcaccctcagctgcagatctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggctggcctccttgagctgtggtgggctccacccagttcgagcttcccggctgctttgtttacctaagcaagcctgggcaatggtgggcgcccctcccccaccctcgctgctgccttgcagtttgatctcagactgctgtgctagcaatcagcgagattccgtgggcgtaggatactccgaaccaggtgtgggatatagtttcgtggtgcgccgttttttaagccggtctgaaaagcgcaatattcgggtgggagtgacccgattttccaggtgcgtcagtcaccccttttttgactcagaaagggaactccctgaccccttgcgcttcccaggtgaggcagtgcctcgccctgcttcggctcgtgcccggtgcgcacacccactgacctgcgcccactgtctggcacttcctagtgagatgaacccggtacctcagatggaaatgcagaaatcacccgtcttctgcgtcgctcacgctgggagctgtagaccggagctgttcctattcggccatcttggctcctcccccttttcttaggttttcttctaggagttttacagtttaaagttttatgttactatctttaatccatttttgagttgatttttgtgtattgtgtaaggtaagagtctgtgtgattttttttttgcatgttgatatccagtttttctttttttaaaagtttagtttaatttctgggatacatgtgcagaaaatgcaggtttgttccataggtatatatataccatggtggtttgctgcacctatcaacccgtcatctaggttttaagacccacatgcattaggtgtttgtcctgatgctctccttccccgtgcccccaatcccccaacaggccctggtgtgtgatgttccctccctgtgtccattgttcgatatccagtttttctaaaaccatttactgaagaggctatatttccttcattgtttatttttggcacccttgtcaagatcagttgacaacatatgtgtgaatttttctgggctttttattatgtttagtcttttaaatataattattttgtttaatcttttaactactttatttaatatttaatactttaattattgtgtataattttttaaattatgtttaatttttttcataatttattgtgtttaattttttttctgggcttttcattatatttaattggcctttgtgctagtaacatactgctttgattactgtagttctccaatatgttttgaatcagaaactatgaggacttcttcttttttatcaagattgttttgactgcttggagtcctttgtgattccatatcaattttaggattattttgtctgtttatctataaaatgctattgggttttaaatacaaatttcatcaaatctttagattactttgggtattttggacattttaacaagactaagtcttctacttcataaacatagtttatctttttatttatttatgccctctttaattttttaacaatgttttatatttttcagtgtgcaagcctttcactttcatggtaactgtattcataaatattttattctttttgatgctactgtaaattagaacattttcttaataccatttatgaattaataaaaatcttgtcaattatttcttgcatggatcatgcttttctttttgtatagtcattaccaaacccaaggccatctagattttctatcttctaggagttattccttcctaggagttttatacttttctcctaggagttttatttttttttattttaaatttaggtctgttatctattttgagttaatttttgtgaaaagtatatggtctttgtctatattcgctcttttgcatgtggatgtgcagttgttcagcactgttctttggaaagactacctactgtactgcctttgttctgttttcaaggatcagttgactatttttatgtgagttcatttctgggcttacattgatctatttatctatatctttttgttaatatcacattgtcttgattactgcagctctattgtaactcttaaagttggctgtgtcagtctttcaactttgttcttcttcaatattgtattggctattctgggtcttttgcctctccatacacagttttgaattagtttgtcaatgtctgcaaggtagcttatgggaattttaattgatattgcatagcatctgtatattattttgggaaagtctaatatcttaaaatattggagccttgcattcatgaaatataatatctctccagttatatagtacttctttgatatattttatcagaactttgtagttttattcatacagaaatacattttgttagatttgtaactgtttcattgatgggaagtgctaatttataattaaataatattatgtttttaatttgaaattccatttgtttgttgctagtatatagggaagaattgacttgtgtatattaaccttgtatccgcaacccttatatattatcccttattagttccaggaaatttttctctattcttttagattttctatatagatgattatgtcatcagcaaagacagttttatttcttacttccaaatccatatatatttttctcctctcttgttttactgcattagctaggacttccagtataatgttaaaaggactagtgagaggagatatctttaccttgttctttatcttagtagaaatactcctagtttcttaccattaaatattattttaactgtagggtttttgtagatattctatatcaattggaagaaggtctactgagagtttttaatctaggcttttaatctagtttttaatctagatggtcaaatttgtgggcataattagtcatagtatcccattatttatttttttaatgttcataagatctgtagtgatgtcccctattttatttcccatactggtaatttgtgttccttctctctttttttttttttcagttagcctggttagaggcttatcagttgtattaatctttttggaaaccaggttttggttttgttgattttctctattgattttctggtttcaattttattaattttggctctcatttttactagttttattttttttctgtttacttggattaatttcttcttcctttcttgatttcttaatgtgattcccctctaagcatggattttgctgcatcttatacattttgataagttgttttcctttcaattagttcaacatatttgaaaatttctcttgagattttatctttgacccatgtgttgtttagcggtgtgttgtttaagtctcaaaatattttcagttgttctggatatctcttagctgaagatgtctagattaattccattctattctgagagaagaaattgtatgatttcttttctttcacatttttaaggttggttttatgggctgaaatgtggtgtatctttgtgaatgttctatgttcagataagaatatgtatgctgctgttaatggattaagtagattatagatgtcaattttaccaaatgattgatgatgttgttgagttaaaatatgaattagaatttaactgtgaaatacatatatataaaatgtacataatagattaatattagatataaattaggtttctcatagccaacatatagttgggtcttgattctttgattcactctgacaatgtctgtcttttaattggtgcatttatatcattgatattcaaagtgattattgatatagttgctctaatatttaccatatttgttagttttctttttttattctttatttttttactttaagttcgaggatacatgtgcagaacatgaaggtttgttacacaggtatacatatgccattgtggtttgctgcacctatcaacccattccttagattttaagtccgacatgcattagctatctgtcctgaggctttcccaccccttgcaccccgctgacaggtccaggtgtgtgttgttccccgatgtgtgtccatgtgttctaattgttcagctcccacttatgagtgagaacatgcagtgtttggttttctgtacttgtgtgagtttgttgaggttgatggcttccagtttcatcaaagtccctgcaaaggacatgatctcattcctttctgtagctgcatagtattccatggtgtatacataccgcattttctttatacagtccatcattgatgggcatttgggttggttccatgtgtttgctattgtgaatagtgctgcaataaacatatgtgtgcatgtatctttataatagaatgatttctgtccctctggttatatacccagtaatgggattgctggatcaaatgatatttctagttctagatccttaaattatcaccacactgtcttccacaatggttgaattaatttacattcccaccagcaatgtaaaagcatttgtctttctccacagcctcaccagcatctattgttggtttactttttaataattgccattctgactggcatgaagtggtatctcactgtggttttgatatgcatttctctaatgattagtgatgtcgagctttttttcatatgtttgttggtcgcataaatgtcttcttttgagaagtgtctgttcatatcatttacccactttttgatggggttttgtttttttcttgtaaatttgtttaaattccctgtaaattctgtatattagacatttgtcaaatgggtagattgcaaaaattttctcccattctgtaggttgcatgttcactctgatgatagattcttttgctgtacagaagctctttagtttaaggctgggcgttggggctcatacttgtaatcccagcactttggaagtctgaggcaggtggatcgtttgaggtcaggagttcgagatcagcctggccaacatggggaaaccccgtctctattaaaaatacaaaaattagctgggcgtggttgtgggcacctgtaattccagttattctggaggctgagtcaggagaatcgcttgaacgcaggaggcggaggttgcagtgagctgaaattgtgccattgcactccagcctgtgggacagagggaaactctgtctaaagaaaaaaaaaaaaaaaagaaactctttagtttaattaggtcccatttgtcagttttagcgtttgttgtaattgcttttagcgatttcataataaaagatttacccatgcctatttcctgaatggtattgcctaggttttcttctagggtttttatggtttggagttttacatttaagtctttaatccatcttgagttaatttttgcataaggtttaaggaagggatccagtttcagttttctgcatatgcctggccagtttttgcagcactgtttattgtagggaatcctttccccattgcttgattttattaggtttgtcgaatatcagatggttgtagatatgtggtcttatttctgaggtctctattatgtttcattggtctgtatgtctgtttttgtacaagtaccatgctgttttggttactgtagacttgtggcatagtttgaagtcaggtgatgcctccagctttgttctttttgcttaggattgcctttgctatgcaggccgttttttggttccatatgaattttaaagtagttttttctaattctggaagaatatcaatggtagtttgatgggaataatattgaatatataaattactttgggcagtatggtcattttcatgatcttgattcttcccatctatgaggatggaatgtttctccatttgtttgtgatctctcttatttccttgagcagtggtttgtagttctccttgaagaggttcttcatgtcccttgttagatgtatctctaggtattttattctcttcatagcaattgtgaatgggagttcattcatgattttgctctctgcttgttgattgttgatgtataggaatgcttgtcatttttgcacattgattttgtatcctgagactttgctgaagttgcttatcagcttaaggagtttttgggatgagacaatggatgtttttctaaatatactatcatgttgtctgcaaacagagacaattttacttcctctctttctatttgaatatcctttatttctttctcttgcctgattaccctggccagaacttccaatactatgttgaataagagtggtgagagagggcatccctgtcttgtgccagctttcaaagggaatactaccagcttttgcccattcagtatgatattggctgtgggtttgtcataaatagctcttattattttgagatatgttccatcaatacctagtttattgagagttttcaacatgaagtgatgttgaattttattgaaggccttttctgtacctattgagataatcatgtggtttttgtcattagttatgtttatgtgatggattatgtttattgatgttaaaccagccttgcatctcagggatgaagccgacttgatcatggtggataagctttttgatgtgcttctggatttggtttgccagcattttattgaggattttcgcaccagtgtttatcagggatattggcctgaagttttcttttttttgttgtgttcctgccaggttttggtatcagaatgatcttggcctcataaaatgagttagggaggagtccctccttttcaatagtttgaaatagttcctgaaagaatggtaccagctcctctttttacctctggttgaattcggctgttaatccatctggtcctgggttttttgtttctttgttttttggtcggtaggctgtttattactgcctgaatttcagaacttgttattggtgtattcagggatttaatttcttcctggtttagtcttgggagggtgtatgtgtccaagaatttattcatttcttctagattttctagtttgtttgcatagaggtgtttataccattctctgatggtagcttgtatttctttgggtcagtgttgatatcccctttatcaatttttattgtgtctatttgattcttctctcttttcttctttattagtctagctagcaacctattttttaattttttcaaaaaaaacagctcctggattcattgatttttttgaaggattttctgtgtctctatctccttcagttccactctgatctcagtcatttcctgtctcctgctagcttttggatttctttgctcttgcttctctagttcttttcattatgatattagggtgttgatttgagatatctctaggtttccgatgtgggcatttagtgctataaatttccctcttaacagtgctttagctgcatctcagagattctggtatgtttttctgtttttatttgtttcaaagaacttgatttctgccttaattttgttatttacccagtagtcattcaggagcaagttgttcaatttctatgtagttgtgtggttttgagtgagttttcttttttcttttcttttcttttttcttttctttttttttttttaagatggagtctcgctctgttgccaggccatagtgcagtgcagtggcgcaatctcagctcactgcaatctccacctcctggattcaagtgattctcctgcctcagcctccagagccgctgggactacaggtgcccaccaccatgcccagctaattttttgtacttttagtagagacggggtttccaccattttggccaggatggtctcagtctcttgacctcatgatccacccacctcggcctcccaaagtgctgggattacatgcatgagccactgtgcccagccaagtttcttgatcctgagttctaatttgattgcactatggtctgagagactgttatgatttcagttcttttgcatttgctgaggagcgttttacttccaattatgtggtcgattttagagtaagtgtcatgtggcactgagaataatgtatattctgttcttttgtgatggagagttctgtaggtatctattaggtccacttgatacagagctgagtttgaatcctgaatatcctcgttaattttctgtcttgttaatctgtctaatattgacagtggggtgttaaagtctcctactattactgtgtgggagactaagtctctttgtaggtctctaagaacttgttttatgaatctgggtgctcctgtattgggtgtatatatatttagaatacttaactcttcttgttgaattgatccctttatcattatgtaatgcccttttttgtattttttgatctttgttgattaaaagtctgttttatcagagactagggtttccacctttgcttttttctgctctccatttttttggtaaattttcctccatccctttattttgagcctacgtgtgtctttgcacgtaagaggggtctcttgaatatagcacaccaatgggtcttgactctttatccaatttgtcagtctgtgtcttttaattgggccatttagcttatttacatttaaggttaatatggttatgtgtgaattttatcatgtcgtcatgacactggctggttattttgcacactagtagatgcagtttcttcatagtgtcactggtctttatattttttgtgtgttttgcagagcctggtactggtttttcctttccatatttagtgcttccttcaggaactcttgcaaggcaggcctggtggtgatgaattccctcagcatttgcttgtctgaaaaggattttatttctcctttgcttctgaagcttagtttggctggatatgggttgaaaattcttttatttaagaatgttgaatattggccccactctcttctggcttgtaggttttctgctgagagatccactatcagtctgatagccttccctttgtaggtgacctgacctttctctctggctgcccttaacattttttcactcatttcaaccttggagaatctgatgattatgtgtcttggggttgatcttctcatggagtgtcttagtggagttctctttatttccttaatttgaatgttggcttgtcttcctaggttggggaagttcttctggataatattctgaagtgtgctttccaacttggttccattctccctgtccctttcaggtactccagttagttgtaggttcagtcttttgatatagtctcatgtttcttgaaggtttttttcattccttttccccttttttcctctaatcttgtctgcctgccttatttcagccagatggtcttccgtctgatattcttccttctaattgatcaatttggctattgatccttgtgtatgcttcatgaagttcttgtgctgtggttttcagctccatcaggtcatttatgtttctctctagactggtaattccagttagcagctcctctaacattttgtcaaggttctcagcttttttgcataggtttagaacatgctcctttacctcagtgaagtttgttattacccaccttctgaagcctacttctatcaattcttccatcttatcccctgtccagttctgcacccttgcttgagaggtattatgatcatttagagaagagccactctggccttttggattttcagtgttttttcattgattctttctcatctttttgagtttgtctagtttcagtctttgaagctactgacccttggatgaggtttttttggtgactttttttgttgatgctgctgtcattgctttctgattgtttgtttttctttcaatagtcaggcccctcttctgtagggctgctgcggtttgctgggggttcacttcaggtcctattcatctagtttactcccacacattgagatgtcactcaaggaggctggagaacagcaaagatgggtgcctgctccttcctctgcgatctctgaccttgaggggcacagacctgataccagtaggaatgcttctgtataggatgtctgataatccctgttgtgggatcttacccagcttggtgggatgggaagaaggacccatttaacaaggcactttggctgtcccttggtggagggtgtttgctgtgctggggggaaacacactcatctgggctgcccggagttatcagagctaggaggaggaaagattaagtctgctggtttgtggggacttctgctacccctccaactaggtcctcagacccagggagatcagagttctgtccctgagcttctagctggagttggatttcctacagggaggccctgcagccacagtgttggctgccacccctcccccaaggagctcagatggcttagactgcaggcagcttcagcagtggtgatggccattccctccccctggcttaggccaattctagctgagtggctgttgagaatctgtgtggctccatggtggtgacccaaggccctggtgacatgggcttttgagtgtgatcttccaatctgttggttgcacacttttgtggaaaaaccacagttttccaggctgggcagcacactcactcattgcctcccttggctgggggtgggggctctcaggtgtcccgtgtggctctcaggtgagctgttgcaccacagtgttctttcttcctcttcgtggatcatgccagccacctagtcagttctaatgacagaacctgaatacctcggttgctgggtgcaggatttgcatgctgctttgtatctttccaatgggattctttgattgctgctgcttctagtcagccatcttgaccccacccaccaatatttgttagttttctatttgtcacccttgtttttctatttttgtcttctatattgtctttgactttcctaattttattattttatatgatttaattttttatgtcctcactgagcatatcaggtgtacttaaaagaaattagaggttgccttaaagtttgcaatatacacttaaacctaatctgattctaatttcaaataatactataccacttcacagaaagtgtgagtacctttaagtaacgttataagaatgaaataatctattccctctcttcctttatatcattgccataatgaattttgcttatacataagcataaatatctattatctgacagtcttcctttcattatatagatatgagtttctgttttatatcattttccttttctctaaatatttcttttaatatttcttgcaaggcaggtctgacagcaacaaattctctcatttgttgataaattaattgtttcctcgttacttttgaaggataatttttcaggttacagaattcaaggttggtgattttgttgttgttgttgttgttttgttttgttttgtttttcaacatgttaaatattttactccaacctcttcttgtatgcatgatttctgagaagtcagatgtaattctcctctataggtaacgtattttttattctctgctttctttcattttttctttgtttttttttttctagtttgaaaagtatatagttagatatgttttgttgttatttggtaggttgggttttcatttttgtttttgcagctatcttgtttggtgttttttgagcttcctggatctgtggtttgatctttgacgttcatttgaagaaattttcagtcatgttaatatgtcttgtaatttttctttgtagcctgacatgatgtactggatagaagacactactataaatagacctttagtaatgtggttgtaaggtgtgtgggtgaggggaagtgctcttaatcctatactcagacctcagtgttttagtaagcccatgtctctgaactgtaaacttcacatgtgcttcacagttttctcttcctttaggtgggaccagaggcctaaaatgggctacagtttggtatttcctttcctccaagtggaaagctagagttagagttgaatatttttcttccttcaggtcaagcagattagagttcgattaaaccatttctcttgagagaagatcttgttaaggagaatgaaatgctctgaagtatttcaaattgttcttcccctcccctcactggaagaaccaagtgattactatctgatacttactataagtacatgctaaaactccaggatgtaaaaactcataaaaattcgagcatcatagtaatgggttctccctggagtttttgtgtctcaggcttgcccacaccaagctccaacaatttgtcagttacaattcaggtttccctacgctcgcgtcatttcccatggaaatttcagcttatgggtttctgctctgttaagttttgattgtctgttttgtgtatcaatctctccaatttctggggcagtggttttctctgtgacctcactttttttaaggatgtatgaagagttgctgatatttcagtttgttcagcattttgcttgttattaagatgaagtggtgacttccaagcttcttatatactggatcaggaaccataaatctcattttgttaattttttaaagtgatgtgctttgatttccttcaggttttcttttctgtatttttaatatatatttccttttttcctttggttactgtggggcttacataaaacaccttatagttataactgtctatttaaaactgataacaatttaagtgcaattacatacaatgagtctacacttttactcttctcccttctcacatttatgttactgatgctgtttatttattaacgtatttctataattataatttttattcattttgcttttaacttctataccaaaattaatagtgatttatgcatcagtgttatagtattacagtattctatttttgtctttatagtaatctttacctgtgatttttataatttcatatgctttcatgttgtggtttagcatcttttcaatttaacttgaaggactccctttagcatgttttgcctaaggcaggtctagttataataacctcgcttagctttgtctggaaacatccctctcgttttcattttcgaaggatagttttgctgcatctaattatatttgttgatggcacttttctttcaacattgaatatgttatatcttcttctgaccttcaatgtttctgctgagaaatctgctgatggtcgtatggaggtttcctagtaggtgataattcatatttttcttgctgctttcaaaattaactctgtctttgacttttgacaatttgcctatcaaaatcaaattgtctttgattctgtgtctgtatgggtgtggagttcttttgatttattttatttgggaggcattgggcttcctgaatctggatgtccacttctttccccaggtttggaaagttttcagcccttatgtctttacataaactttctgtttctttctctctcttctcctttgggaactctcataatgcacatgttggtcaccttgatgatatccataaatcatttaatttttcttcactcttttactctttttctgttgttgttttttttccttttgcttgttattaagcttttctgtcaggaaaatttcaaattacctatcttcaagttcactgattaatttgctttataaagtctgctgttaatcccctctagtgaatttttaattcagatattctattcctgagttgtaacatttgattcttttttatattttctctttatcaaaatttttattttgttcacatattgtttttcttagcttgcttatgattattttgaattttttgttgggtaactcctataccgccatttctttagtgtcagtttctgaagttttatttatttatttatatcttgattcatcagttttcccatttttttcatgtttcttataaatatgtgttagtatctgcgtatttgaaaatacaactatctatctctttaatttttcatacatacgttcatacagggaaggacttttatcacttagcctggcaagagattctttgggcttctcaagccttttctttagatgtatcttcttggacttgtgcttgtaaatttctaattcaagatattttctatttttggtttttccccttaggcactcataacctcttgctctccctagtgtctgcttgttgtagcactggtcctctggagaagcagaatgcttcccagctctttttttctcaatgacacccagatatctagagtatgctgggtctcatcagtgctctgagagagatgagacaatgtctgttcctctggcagctcctgtcttctttaaaagtgtgaacattgaatgtatgtttcagtctttttttccatccctagggggaaactggttgctgggagttttctcttaatcacatagtgctgtgctgggggtagaaacactatgacaagagggtagtgtaaactcttctaatagtcttctgctatggtttgaatctttgccatctacaaaattcatgttaaaatgttattgctgttgtaatagtattaagaggtggaatgtttaagaagtaattgaatcatgagggctccaccctctttgatgggattggtgcaatcataaatgggcaagcccaatccctcttgctctctcttttccttttgctctgatctcttgtgaagaaaagtgtttcctgtcctctggaggatgtagcaacaagacataatcttggaagtagagagcaaaaccttaccagacaccaaactttctggtgctttgatattggtcttatcagcttccagaattgtgaaaaaatgtgtttctgctctttataaattacccagtcttagatattctattatagcagtacgaaacagactaagaatctatgtggtggtttcatgttcactcagatacagaagcctcttaatggatttctgggtttcttacaaacaaaactcatctgggcttggcgcagtggctcacgcctgtaatcctagcactttgggaggccgaggcgggcagatcacaaggtcaggagatccagaccatcctggctaacacggcgaaaccctgtttctactaaaaatacaaaaaattagccgggcatggtggcaggcatctgtagtcccagctacttgagaggctgaggcaggagaatggccagaacccaggaggcagagcttgcagtgagctgagattgtgccactgcactccagcctgggcaacagagcaagactccatctcaaaaagaaaaaaaaaaaaaagaaaactcatctgtgtactcttgttgaattagtgtctccatgggaggagtaagagtctggtgcttcctattccactgtcttgtttgaaaccaatttatttgtattctttaattagagtatatttctctcagttactacattatgaatcagttattttaaaattattttagaaaatgtaattatgttatctaattatgaaaataatgtaaacattatgtatacatttgagaaaaactattgggggaaccagcccccaatatttcaacatagtttctttctgttttccctaagtgtcagccagtctgagaaataaagagaaagggtataaagagaggtaattttacagctgggcctctgagggtgccatcacatattggtagggccgtgatggcgacctcgagctacaaaatcagcaggtttttattagggatttcagaaggggagggggcacacgaacagggagtaggtcacaaggatcacatgcttcaaagggccataaagatcacaaggcaagggcaaaattagaattactgatgagggtccatgtcccactgtgcacgcattgtcttgataaacatcttaacagtaaacagggtttgagagcagagaaccggtctgactagaattcaccaggctggaatttcccaatcctagcaagcctgagggtactgcaggagaccagggcatatttcagtccttctctcgactgcataagacagacactcccagagctgccatctatagacctacccccaggaatgcattccttccccagggttattccttgctgcaaaaagaattcagcgatatttctcctacttgctttctgcaagaagaaaaatatggctgtattctgcccaaccacgcaggcagtcagaccttatggttatctttccttgttcctggaaaattgcagttattccgttcttttttagggtgcactgatttcatattgttcaaacacacatgttttacggtcagatttcatgttgttcaaacacacgttttacaaacaattggtacagttaacacaatcatcacagggtcctgaggtgacatacatcctcagcttacaaaaatgatgagattaagtgattaaagacaggcgtaagaaattattaaagtattaattttgggaactaataaatgtccatgaaatcttcacaacttaattcttctgccatggcttcagccggtccctccattcggggtccctgacttcccgcaacaaaaaacagattataaaacatgtaacttataactatactcttgtcaacatctcctgttaacctttcctatgtgttgtttaggctttcaattaaggagcagagagcttttgtacattttaacaaagttgaatactataaagttagtggaacactttttcattgcacattgaaaagtgagcatatttctatcagtaatcattttaaaaaatattaacttattggcagtataatatattctatgggttttcataatttaatcatttaccttttgattaccatttacattgcctaaaatgtctgaaatacagttttgtatacttaatatataaatatgtagatatttacctgatttttttcctaagaaaattttgtacaattaatggtatttcctcaatgtgtataaatatatcatacttgatacatattataaattacttcctataaaagctctaacaactttttcatgctctttgcttaggttttgatttgagcactagatagtcaatattctaatgtatagaatggtatgtagtttgtaacagaggaagtgtcataaatcagtgggaaaaggccagtaatttttaaaataaaatgtgttagaaaattatctgtacaaacaggaaaaataatcaagttatttaacccaacataatgtgtcaaaaattatttcaaatgaactagttattaatgaaatatcaataggaagaaaatatgggtaagcaatttttattcagtggttctatatacaaaataatgagattaagggtaaaataatagtttcagaataatcaaaaatactattacaaaagagatgtattaagaaggagtttacaaagtctaataagaaaaacatgaacatttcagtttaaaaatagaaatggattttatcatatcattttaagattgtttcaaaaaataatttttaaaaattttcactgttatttactgtcactattgtgtacagaaatgaaggttgggtcaccaatatctgtatgaaatatgattttacatatagtgatcgaattcatttgagtttaaataaccaagatgtaataaaataaatctctttactacaaatggtttacctgcccctgtgtagactactttaatgtaaaccaagcagaatatgtcttgaatctaaattaattattgtgaaattaatcaggtacgtcattatttcacataacaaaaaaattactcatactgtacacttggtacaagtgagtgaatgcgttgcatggtaccatccatgtacttcctttgaccagttcaattaatagtagttattcatctctgaaacaatgctgcttaaataattgaactgaaatcattataggtagttaggcagtgttaggatgaggtaactaatcagtgtataatatttaaatggacagttaccctggttaactagaatgtatgactaaatatgattacagaaactgaaaacatagaaacttctccttttgacacaaatatgaaaatattttccttctattgattttgcgctagttatagtgcactgtgccttacacattaagttagagtatctcttttgatgctctaacaaactctgtgacacaaagtcatttaactacttcagctaaaatagaattttgattcagaatgtcaggctgaacatactttccctagcacacaatatcttattgaaatgaagcatatacacttatctatttaagtacatccttccatgtgtatttagattcaacatagtgctagaaaaactgaagggttatattagtgaatcacacatatttttggaacttggtaatcatacaattcttatgttatttgaaacatttcccttttaatgtttctacttgcttagcatctaatcagtcatttggtactgctatctaaattcttttttggtgctctaccccttctgcatagccagaagtcccccaagtatcagtcacttgacttcgtttattttgactgtggtgtctaaatgcaattgactttgggtcaattgtcagtcttttccttaaaaccttccctctgactacatcaacaagaatcaattttcatttcaggcaatcaataagtcataatttatataatcaacaataattgttcaaaataatgagaagtatcacttaaatggtgtcagaattgtagattcgaaactgaactaagcaagaaaattaatgaaaatgcaagctctttatgaaataaacataaaaaagacttaaaaattaaattggaatatcaaaaacataaaattccaccaaaactagttgtgatttcaacagagtatcaataaaaatcttgatgagtacacccagagtaattaagtctgttgactactgaaaataaaaagaagttaaggagtatttctaccttgcataaagaggtgactaattaatttctaaattttgattaaaataaactgatattcaaatgcatagttctttgaaatggaaatatattggttgtgttacagtttcatggccctgattataatataaaaagtcatgttttgtttaattttctttttttttcttttttttgtgggggggacagagtttcactcttgttgcccaggctggaatgcaatggcgagatcttggcttaccacagcctctgcctccctgatttaagtgattctcctgcctcagcctcccaagtagctgagattacaggcatgcgccaccacgctcagctaattttgtatttttagtagagatggggtttctccatgttgggtaggcttgtcttgaactcccgacctccaggtgatccgcccacctcagcctcccaaagtgctggtatcacaggtgtgagccaccgtgcctggccattatacttaattttcttcataaaatttgagaatccaggtttgatatgtgtttaatattaatttaataatacttttattaattatattttttctaaaatttctatttggttattttttgtaatccaattggccaattatgaatctctttttcttccataagtgtagtcttatatttgctatttcatcattgtgatgtctctatctatgtgtatattcgctacacatagaaagtatacatatatatacacaaaaatgtataatagtgtgtctgcatatatatatatgtatgtagacatgtttttaagagtatagtgactatgtgctgatatactaatatatttgctaatagagcatgtatttcattgagagtttatattccctaaaatagcatcttattatatagagagattctttgaagcttgggataaggttaattcattcagaaataatttattttcctttattccaagcattcagagtcactaaaacccagtatggtttgaaaatgaatgtttagttaaaggattttattgcctcacaggtggtatggactctagccccaatatcatgagtgagaaattttcagagacttgctacctttttgttttttcatttaattcagagccaggaccaagagaggaaaatatctccaggagctctttctctgaggtgggctttttccacttcacccactgagagtattgctctttgggggcttatgtaggaggatttccacatttgatctttcacacgtactttgctactgcctccagggctttcttacccaccgccagacagatacaactgtacactttctttttattaatgttttttgataaattctgttgctgttctgccacctcatatagttttaaatattttatccagaatttttaggaggactacttggggaagggtttcagaaaaatctaagccaccatattctgagcttttccttatgctcaagaaaacctttgtttaatgttgagattcttgagaatatgcattcttccaacaaatatttgttgagtgcctatatgtagatacataagtgaacaaaagataaatatccttgccttgatggagcttgcatcctaatggctagaaaatataatatacaataagtataagcaataaacaaatcaataacttatacaataagtataagcaataaacaaatcaataacttagatggcaacacacaccttggggatagcaacagagaaggatgaaaagctagaaggagcagtatagagtagtcacggtgatctcattgagaatgtgagatttgggcaaagatttaaagttggtaagaaagatgaggtaaatgtatggtttaattggttattgggctggacatcaaatctggataatctcttcttccttgatctgtagatggctccatagacatagcatttgtcttacattgcctgctgagaaggggagaaaggggtaaatgtgggagcaatagatagtaagaggggatctctaataccaaatattgcccttcttcaccttccctattttgcagtgagtaaccatattctgataatttctgtgactaattctataaatatattattttagtaagttctttggaagtctctgaggcatattcaaaatttaattttttaatttgtatttctctagatttcctcaggtttgtctataactgttttccaaatcacacatttctaacattagataagtgtacatttatttttttcttatgccaagtgacaggtacttaatatacaagggatattttgtgtatagtattcattctttaggagaacaacctctttaaatgtgccacagaattcagaaggcattgtataattggaaattaatcaaaacttcattcttctcagatgcacttatctttaagaatttgctctacagggctataaatgctatctatatttatctgcaaataaatatacatttttaataataaagaagtagtgtttaatattgggtaaagtattgatgtttacatggtattcgcattggtatggactgttacagagatgtaaagccctttctaaccaagttatttcttaacatttttaaagcaaactatatatatttggaaggagaatatattcagaaaacattctcaaaagggaaaataaagttcaaagataacattaattggtactattactttatacttttcttcctttagtagtctatctttacaaggagaggaatccattcagctaatggatgtcgtgctcaaagttgcctcggcattgtccatcctgagatatattcctgttccaaacctgttttggtatgttagactagtaggctgaggtttatcttaaaataagaggatgtcctttaataatctctctaatcattagtttctatttaaactgagaccttcactatcccagtgctgatgctaatagccagtagggaattattcttcttatcgtaacttcttctggcttaatttagaattagaataaaatgattttattagacttgggactatttctgggcgtatgataaacaacagaaagaaaaggaacaaggcctgatgtttaatttctgtgaatccttctgatattcttcttttcctttgccttaagataaaatcaagtttgttcttttcataatgatctaatgctttcaggtcttccgagtctgagtcttgataagggtctttaaatattacttttaactacaagttccactacattttgtaaacataaatgaatatgaccttgagataataataaataaaattttgtctatatagttcatgattaagtcttttcatttaaaaatgtgttacaatcctgcagatcatcgtatgttatttgtcattttctatataagggaggaggaaagggtatccaaacaacatttatcttgacagcataagttcttaaaaatggaaaacatgatcagaggctgaatgagtaaaattaggaacaacaatcagggtagggagtaattgcatgattctgtttctagtccaaaatagtaatattaatatttaaatgttcttatttaagtgtgaagatacaatttttttttgaggcggagtctcactctgtcgctcaggtgggagtgcagtgtcatgagctcagctcactgcaacctctgcttcctgggttcaagctattcccctgcctcagccttccgattagctggaattacaggtgcgcgccaccaggcccaactagtttttgtatttttagtagagacgaggtttcgccatgttggccaggtgttctcaaactcctgacctcagatgatctgcccgcctcggcctcccaaagtgctgggattacaggcgtgagccaccgcgcctgaccagaatatatgatttttatatgtatttgaattcaagttttttgcctaggtcaggagggttttgctgtattgtcttcattgagatgaatatttgctatggttatcataaagaccatagacaatgattcgagtagccagttccccctctagggaatgagactgcgtcatagattttgcaacaatggtttgggttttccaattttgtcttgacttcaacacaaagaaaaattcctgtggccttattcctctttgttgttatatatacttctctgtgacctacatagggtttgacttccaagaattatagtagtacaggtctcatagttaaaaataatggatttctttggtacatgtttaagtgcattatttccttatctataacaattgctaggagcttctatgcctttctttatatccttgctgattgactaaaagaagatacatagtttctactatcatatgttttggtggaagagttcctcttacttttaagagaaaaatctgtgagaaaatatttcacataattctacgcatacgttatacttttacattgtaatataattttaatatcattttctgctgtaaaaaaagacaacagaagagttaccataaatttttatttaaacaaaataaatgattgacaacagtagaataaccttttaattttttattataaatattgaagtaactattacatgaggagaaaaagatagactatcctcataattatgccaacaaaattattgaatcccacttcatttatcttgaagtacttattccattgtatgttgatgtttattttttgctggtggtaaattatatttaacaattgttaccgtgttattttagccataatttttaaagaattatgctgtgctctaatttctttactattttggtaacatcaataatttttattatgttgatatatgctcttttatgctagaaaacaaatagggatgccttcaagtgatcaaaaaacttgtttttgatagtttatatactttataaaattatgataaagttgtatatgtgtctttatatttaggttactactgctgtgtttaaagttttcagaattaaatattgatatgtttcagatttcataacgtagaaaatattttgaaatactaattttaatttatatattgccaagtatttaaatcatgatgataatttaaaatgttatgtagatcaagggatttttattttaatacgttgatagttacaaagttataatagaattcaccttcaaatgtatcttggccttagagtgactttacaagtttgaaagaataatgataataacatcgatttattgtaataacatgatattgtgttatactgtgtaccaggcaacatgctaaatactttatatgccccatgtggtttatataaggcttaaagtaaggactcctaattaatttttccattttaaagatgaaaaatttgaagctcagaggggttatgtcatttatctaaggtgacataggaagtagcggagtaggttcaaactgggccaatgtggcctcaaagcccttgttttaactgctactataatcagtagagtgttagtacagcccaagatataggctctggaaagtgaattttcaaatatttatcaatattgtgggtttgttattaaactatcagaaatttcaaatgagccatggtggaaatatttagaccttggaactcagcaaatgctacagatcaaggtttcttctatattcccctttccttcctgcattgtacagtatactagcatatcagtgcctttactgccaaagtcttgtcagtgtttgcaatattacatgtattatgttagagatataaatactgggcgtaatcttttacatcttgtattaagtactgtctataaactggaatctattaagaaacttactattaatagttattgaattaaatacattaacttttgttgctaaaatatctaaaataatttattaaagacaagaatgtgtgaaatgaactatctctcttcttttcagtgatagtggaaagtggaaatataatttcttttgtgggttatattaactctggatgctgtaacatttatagaagtattataggatttgtgaaactacgatcaaataaagtggtaagttttcaacatgtattctttttaatcaattaatctactctaaagaatagtgtcagataccttttcatgtacttactagacatttatttgtattactttgtgaaatttctattcaattttttgaaatttttgtgtttgtttttggtttagttataagatataagaatataagttgtaagatatattgatttgtaagatatacaaatgatcaatgaacacagtaaaatatgcttcacgttcttattcattagagaaatgcaagttaaaaccatagccaggtactactacaaacataccagattggctaagatgcacttaatcatttgacctaattccactccagatagtttctccagagaagtgaaaacatatgtctacacgaagacttatatgaatcctagggctgggcacagtggctcatgtctgtaatcccagcactttgagaggccgaggcgggcggatcacgagatcaggagatcgagaccatcctggccaacatggcaaaaccctgtctttactaaaaaatacaaaaattagctgggtgtggtggtgcacacctgtagtcccaggtactcaggaggctgaggcagaagaatcgcttgaacctggaaggcggaggttgcagtgagccaagattgtgccactgcactccagcctggctacagagcaagactctgtctcaaaaaaaaaaaaaaaaaacttatatgaattcttacaaactaaaaactggaagtagtccacgtatccactgacagttgaatgaatagaaatgttacagtatatttatactatgaaatgccacatagcagtaaaaataattatggatacttgtaagaatctcaaacatactatgtagggccaaaatgccaaacctgaatgagcatgttctatataattccatttttatgaagttctagaacaggcaaaaatatataattactgtggtagaaaagttagaactaatcattagttggtcagggagacttcaatggaattcaattaaatatctaaactaacttgaattctgctgcactaatcatattcagtgtaaagatttgccatttatataggtgcaaatattcaagttatattggatttgactccaggttatttagtaaatgctttagcctcttccaagttcttgccactttcctacctgagggctatattctcttttatatatcttagtggtcatcaactcctagcaaatctccccgcaaaggtaatttgaggtctcaaaattttctccagaaccattcatattgaacatcctgtaggcccttctccacaaggtctcttatttgaaccaaaattatagttccctgagtcaaactcattttccatgtttcttttgtacttaaacagaaaagacagggaataatccctcctttttgacttaataccatcggttctggccctggcattttctgcttattttccttcttccctgtgggttcaacaagagtgccttgtgactagggctgatgtaacaaacagtggttgacaaaacatcttaaatgaaactatgctcacaaaatgatatcctagatccttgaaatgtggaattagttcaatatttcctaaacatctttgtggattctaaaggacaatgctttcaattaccttagatatgcctaagttatctatgaatttactattgctctaatataattgaaatgcttatgtaagtaaatttttctgtaatttaaatacaattgctaatttattttaaatatcatttagtaaaatggtttatgagtgagtttctgataaaaacaatactgattcattatatggaagcagttgcattaaacatcaataatatatttttttaacagaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttggtaaatgcataaatatcttttaactgttataccattttattggatgagttcttaaattttttaaatttttttccttattaatcagatgcatatttattaaattggggttcacctgcaaaggatggagtatttgcataatctcctccagatcatttctctcttggtgaattttgaaaagggcacatgtttgtagagtgggctggaagggaacttcattttcatcatatagaaagaggtgaggacttgatgccgaggtttgatgcaggggctgcctgaggcttggtctcctggtcctccaggaccaccctgaactgaagttggagaacccagggcaaccagccctgctctgtgtcctgtccttcctgcaacttgctggacctcacagctgaaaatgggagccttgtctcattctctgtgtgagtccttaggataatggtatagtaataataatagcaataataatattagtctaagtcacacaatagtaagtgaaagcattccattgcagcataaactataaagaaatatttatggtaagcattcaggggtacttggtggatcccaggcagggacctgggcctcatgagggtactttaattctctaggatttctttttttttaattttattattattatactttaagttttagggtacatgtgcacaacgtgcaggtttgttacatatgtatacatgtgccatgttggtgtgctgcacccattaactcgtcatttagcattaggtatatctcctattgctatccctcccccttccccccaccccacaactgtccctggtgtgtgatgttccccttcctgtgtccatgtgttctcattgttcaattcccacctatgagtgagaacatgcggtgtttggttttttgtccttgtgatagtttgctgagaatgatagtttccagcttcatccatgtccctacaaaggacatgaactcatcatgttttatggctgcatagtattccatggtgtatatgtgccacattttcttaacccagtctatcactgttggacatttgggttggttccaagtctttgctattgtgaatagtgccgcaataacatacgtatgcatttgtctttatagcagcatgatttataatcctttgggtataaacccagtaatgggatggctgggtccatcagagaaatgcaaatcaaaaccacaatgagataccatctcacaccagttaaaatggcgatcattaaaaagtcaggaaacaacaggtgctggagaggatgtggagaaataggaacacttttacactgctggatgagttttttaaaagagtagagatatttcacagacaaattgggatactcaagtgagtgtttgtatgtatattatgtacaaagacaacatagctatacactgccccttttataatatattctgaattaattgtactggtgttagaatatattagcaatatttcaaaagactttgttttgaaattactaaaatctctctgccacttcccaggttaccattaatagcaatgttcccttcttttctgggacatcttctggctttcatctctaaggtcattgcttttatgtttttggttcaggtcaagtatgtaacatcctcaatatttaattaagatcaagcatatatgaaaatctaaggctggtagtatataagactttatctaaaattttagagctctagtaataataacagaataataatgcagccacctgtattcagccctccaaatactataaatactcaaattggaaatacaattgagtatgaaggagaaatgaatagaagctaataagttgtaacataataggatattaaagaaaattgtagatatgtacaataaaactgggagtaaaggatgaaagcaaagaaatttgtagacattaccatgggtgagaggtatgcttcaacagactaaattgaaagttgttcatgataaaccatataagatttgactgaatactgttatcctgaatttcaattatgttttatgtctctgacatgatttggatgtttgtcctttccaaatttcatgttgaaacgtcatcctcaatgttggagctgcagcctaatgggaggtttttgggtcaaggagatggatcctttatgaatggcttagtgtccttcctgggtaatgagtgagttctcactctattagttcatgaaagagctggctctttaaaagtgtctggcatgtttctcttgctccttctttcaccatgtgacacacctgctcctcttccattttccaccatgaataaaaccttcctgagtcctcaccagaagccaagcagatgttgttgccatgcttgttagaccctggcaaactgtgagccaaataaacttcttttctttataaattacccagcttcagatattcattaatgacaacacaaaactaatacagacgtggggtgttgctataaagatacatgaaaatgggaagcagctttggaactgggtagcaagcagaggttggaagagtttgaaagtctcataagaagacagcagatgaaggaaagtttgaaactacttaggatttgctaaatagttgtgaacaaaatactgatagaagtatggatagtgaaggccaggcttatgaggccttagatggaaatgaggaatctattggaaaatggaataaagtgtatccttgctatgccctagcaaaaatcttggctgcattgtgtccatgccctaaagatttgtggaaagttaaacttaagagtggtgacctagggtatctggtggaagaaatttctaagcagcaaaacattcaagaattagtgtgggtgcatccaacaacgtacaatcatatatgagcataaaagatgacttaacgttggaaattataattaaaaaggaagcagagcataaaatttgaaaaattcacactctagctatgtggaagagaaggaacgtgcattttctagagagaaatttaaatgcactgtggagcaacaacttgctagagggattagcttgactaaaagggagacaagtgccaatattcaagataatgggagaaggtcctcaaaggaatttcagaaatcttgaagacagctcctcccatcacaggcccagatgcctaggaggaaagaatgttttggggagccaggctgaggatactgctgccctatgccacctcaggacgctgctctcagaatctgagcagagccatcctgggctcaaacagccccagatacagcatgggctactgctccagagactgtaagctataagcctttgtggcttccacatggagttgggtctgcaggtatatgaaatgcaagagtgaaggaagcttgctatattctacctagatttcagagaatgtatcagaaagccttccagagagaaggctcctgcaggggccccacagagagcctctataagagaagtgccaaaaggaaatttgggattggagctaccacacaaagtccccattggggcactgcctagtgaactgtaagaagtgggctgccaccctccagacctgagaatggtagagccatgggcagcttgcactctgagcctggaaaagctacaggcgtttaactccaacccatgaaagaagccacgtgggctgcatccagcaaagctgcaagggtggagctgcccaaggccttgggaacccatcccttgcaccagtgtacccataattagagtcaacagagacgattttggagctttaaaattttaatacctgctcttctgggtttcagacatgcatggggaatgtttcccctatcttttgtcttatttctgtcttttggaatgggaatgtttacttgatttctttagcaccactgtatcttggaaattaataacttgtttttggtcttacaggctcataggtggaaagaatgtgtcttgagtctcagatggaactttggacttttgagttgatgctagaatgagttaagaccaggggactgttgggaaggggtgattatatattgcaatgtgagaaggacatgagatatggtaggccagcaacagaatgatatagtttggatgtctgtcccctccaaatctcaggttgaagggtgatcctcattgttagaggtggggactggtgaggggtgtttgtgttattgaggtagactcctaataaagggcttggcttcatcttcatgataatgagtgagttgtttctctgtgagttcacatgagagctggttgtttaaagaagcctagcagctccttttctctctcttgctccctctctctccatgtgacatgcctgctccttctctgccttccaccatgaacaaaagattcccgaggcctcatcagtagccaagaagatactggtgccatgcttgtacaacttgcagaactatcagtcaaataaacctctttcctttatagattacccagccttgggtattccttcatagcaatgcaaaactgactaatagtctcttacagaatgtgttaccaatacttgcataacactaactcaaaatgaaaaaaattaattcaaattcatatgtctaattttaaaagttgtaaatctgaaatgacatttgttaattttattttcttctgtgacattcaaatacaacctccctcaaggtaaacattgcttaaaaataattactaaccaccaattaaaatgacaatattctcacttaatattttttcttttcctatataataatatgttttttcttttcctatataaatgatgttaactggtgcaaggcaaatacactgtggactcttttatgtaaaacaacatttcacacgttgtattatacaaagttcttcaaaaaaaacagaaccaataggatatatataaatatacaagaggcgatctattatggggattggctaatgtgattgtagagtacacaaagtcccatgatatgctttcagcaagctggagaatcagtaaagccagtggtataattcaggttgtgtctgaaggtctgaaggggaactgagggtgtaactcccagtgtgaggccaaagccttgaaaactggagagggcagacaggaggcagttgtattaagtcctggagtctgaaggccagagcaccaggaatcctggtattcaagaactgggaaagatggccatcttagctgaagaagagatagacagaattcctctgcctttttaatctattcaggcccgcaatggattaggtgttatctgtttgcattggtgttggtggattttccttaattcatctactgattcaaatgctaatctctctaaaaaacaccctcaaagacacatctggaaatgttttaccagctatctgggcatcccttagcccagtcaaggtggcacataaagttaagtgtcacatacaaaagtgtttcttttagtcacttaatagaatctcctttgtcatctggcagcctaacattcaaatacttggcattgtatgggatttagtaatgtttgtgtgtgtacaaacattttaattcattccatagtctgttttattccatagtctgcatacatcagactattccatagtctgaatttcattttaaattcattccatagtctgttcatttgagagtgatgttctaaagctgctgacatgatgtgtgcctaattgaatattctctaaatagaaatgtgcttgaggactagattttgcttgttttttcaaaatttacaaggaaataaaatattgtgtttatttcagaaagcattttatttctacattctaatatttcatattctattccaagatagttaaatgtacattttaagggctagataattctaatgaaaaattaatggttaattttgctgaaataattttcacatatgaagaacaatgatattaatttgcatttaatctgctatatcctatctccatctacttcatttattatttgaaatatagatccacctctatgaaataacataggacaggactcaagagaaagtaaaatgagtcttaaatatatcaagttgaagacaaatgaaaatgctgtgctggaaaactcagcgtgagcaaactctatgttatgtcatcttgctatcaagtgttattattagctgttatattacataggtgttaggaataatttaaatttgagaaagtccactaaaaataaacaaaaataaataaaataattatgttccaatagaatcctcaattattagttggttatgttgccttcactttctaatttttcaagaattgttaaaaacagcaattcttttagaactataaaggtattactgaaaaaataaattaatgcttatctttctccaggtatatgggttatactctctatttggtcttatgtaaatcatgtaaagattcagttcatcttgaatgaatcaacaatatttggtaaatacccaaagagagcaattcactcactgtacctgtacttcaagataggtagaatagaatctagagaatattaaagacttcataaatgttaaatgctctactggagaattatatatgcaaccgtctatatataaaatatagtaagatgtatgcagcaattagttttgtaatatttaaaaggacttgaggagtggcttatttgttccttttggtggttaacttttggaagttaggaaatatctttttttaatctatatgcatccttctcagacattgccttgaacatctaaataagaatgagaatagcattattaagcttaagcaaatataaatttcctctgtttttcacatgctactgagaatgtagtttattattatttttataaagtcaatatatctttgtccagatgcagagcttattactcaagtcatttaaggtaaagataattgcaagtcaatataactattttaattttactgatgtcttaaattctcattccaccattagaacaagtgtactacttttgtaatgagaaagaatttctttttatctataaaatgaattactgatgttttttattatatctcattcaacaacttatgattgaaaaataaggaatagctaatgtgcttaatttgccataccgaaaaggaaaatttcaattccaaggtgttattggtataaactatctgaaagtttctgcttgtttttaaaaaggaagaatgcctaaagactatctctcataatgcttaatacaaagcacaggaggtcagagtttttactgcagatatatctgttaagcatttcaggggcaataaatatattcatattcaaaaacttcttcccaacacatcagcatttcaccttaatgatgagataagttatagccaagattatccttgttaaattaacaaaactaataaaaaggatttaagctcttgaacagtttgccacagggaatacacgactctttccccttttgcgtttttgcattgtgatttaaaattttgatatatgcaattccaagttaaaaataagatagggcacttatttttaaatcagataaaaatgcttaaaagcatcttctcctcttataatttgttattccttactaatacatgttaaattttaaaaatgtaagttacaaagttgagtgaaatgttttttgaggaaaaaataatattttatttgcaaagcttgacaaaatgctaatatctttaatgataaatgagctcttagaaatcagtagaaggagattaacattacaagggaagtgaaaataaaaagaacagaggaaaatgaaataacacaaatgtcttacaaggctatgtgaagatgatatagcttaccattaatagatgaaaaagcaatttcactataaattacattatcaatgcttacaaatattgatatctaatgtttatatagttttaggaagggaaaatcctcaaatactgggaaaatttactccagttataggaaatttactcaaagtatagattttgcatatactttgccccagcaattccagttcatggggatcattccaacaaaatagttggatgaatatatatatatatatatattcttgttcactacatagaaaatctttggctaatatgtcatcccccaagaaactacttatgtatcaattggtttataaagaaatagatgggggggtagaatttgaaatataaaaagcattgaagtaaaaatacaagatttcacaaaattctatgttccttgaattcttgaaaaagaactttctttaaatgaatcagttttatatttactctgtgataagtgaaaattataaatgtatacacttcagacttatggaagcactgagatgaaacacttttaattccactatcctggcttctttgtttaagaatgtctgtcattccatgtcctgagattgagtccaatgacaaaccatgaaaacaattaccatgcttacttaaaatctacttcaatgacactctttaggttacttttcaaaaatgagctttctcagtcaagtttttctgatctgcaaggaatgtccactgcaatgcctgtgaggagtctccatacatcatgaagaccatattttggttttggtgaagatgatattagaaacaagggcacagtctccctctttcagtcattaaaatcatattgccaagaatgcttgaatgagaatactgcaacaggtcattcagtgataactgaggtttttcaataccagatgtgtttatccaagttcaggaggaagtgttagctattgtacacactgccccttgttcatccaacagacagtccaaggcaacttgattatctacaaaaaaatttagcaagggagtttagaaaagtttgttgggcacctatagcctttgcagtaaacttagctattactatagctaatgcttgagacagatttttaatcataaccttatttacatttgtgccaagccaataaagttacattctaccaaagatggccattaagaggaatttacaccattttgtctactccatggcaagtcatggactgcagtttttagtaatggaatctttaaggactcagaaaagaccaggcagccattcgaaccctctgtgagtccacgcttaacattaaatttatatccttttagataccaattttgcttttccaagtcaggtacatataacactgcttattaaataggttattataggtgatttgacttggatcaatcttatggagttcattcaaattgcatattctaactttttttttgtactttaagttaagaacgtgcaggtttgttacatgtatagacacatgccgtggtggtttgctgtacccatcaacccgtcatctatattaggtatttctcctaatgctatccctcctctagtacgccccacccaacaggccctggtgtgtgatgttcccctccctgtgtccatgtgttctcattgttcaactcccacttatgagtgggaacatgaagtgtttggttttctgttgttgtgttagtttgctgaaaatgatggtttccagagttatccatgtccctgcaaaggacatgaactcatcctttttttatggccacatagtattccatggtgtatatgtgccacattttctttatccagtctatcaattgggttggttccaagtatctgctattgtgaacagtgccacaataaacatactacatgtgcatgtgcctttatagtagaatgatttatcatcctttgggtacatacccagtaatgggattgctgggtcaaatgatatttctggttatagatccttgaggaattgtcacactgtcttccacaatggttgaactaatttagactcccaccaacagtgtaaaagtgttcctatttctccacatcctctccagcatctgttcatgtaagtttcctaactttttaatgattgccattctaactggcatgagatggtatctcattgtggttttgatttgcatttctctaatgaccagtgatgatgagctttttttcatatgtttgttagctgctaaatgtcttcttttgaggagtgtctgttcatacttttcgcccactttttgatggggttgtttgtttttttcttgtgattttgtttaagttccttgtggattctggatattagccctttgtcagatggatagattgcaaaatttttctcccattctgtaggttgcctgttcactctgatgatagtttcttttgctgtgcagaagctctttagtttaattagatcacatttgtcaattttggcttttgttgtcattgcttttggtgttttattcatgaagtccttgcccatgcctatgtcctgaatggtattgcctaggaaattttggtttttttttttttaaacgaatgaaaaagttttagacaaatctttgacaaccatttgctggctcaaatgttgttgttttctaaggtgtttctcaacatattgttttattccattaggtattttatagaggtattatactgttttgttaatgagaaaactagctaaacattttgaacatcttgctgacatttaaaattaatttttacttggagagattatctcaaaaaatattgtatatcacatatatttataagtatctatatatatgtatatatattcacacatctaatgtgtggaaaagataacattactcagaaaacaatgatgaccttgatattttagcctgacaatatgtgtttgaccactcataaactttgtaaatgtttgtttattttgtaagaagaagttaatgtttttgctcgagtttggcttttagataattttttctctatcaagtgtattaaactgttttactttttaattcttttaaatccaatttgtctttttattttattttttaaatattttaaattttattttatgttcagaagtacatgtgcaagtttgttatataggtaaactcatgactcagtggtttagtgtatagatttttttgtcacctaggtatcaagcctagttcccattagttatttttcttgatcctctctctcttcccaccctccccctctctgataggccccagtgtgtattgttcccctttgtgcattcatgtgttctcatcatttagctcccacttacaaggaaaatatgctgtatttggttttctgttcctgcattaatttataaggataatgtcccccagttccatccacattcctgcaaaggacatgatatcattcttttttatggctgcatagtattccatggtgtatgtgtaccacaatttctttatccagtctattgtagatgggcatttaggttgattccatgtctttgctattatgagcagtgctgcagtgaacatcgctgtgcatgtgtctttataatagaactattcatattctttttggtatatacccagtggtgagattgctggatcaaatggtagttcttgttttaggtctttgaggggttgccacactgctttctataatggttgaacctaatttacactcgcaccaacagtgtataagtgtccccttttctccacaaccttgccagcatctgttattttttactttttagtaattcagtcaaaatggctattctgactgatgtgatgtgagatgacatctcatttaggttttgattttcttttctctaatgattagtgatattgtgctttttttcatatgcttgttggccgtgtgtatgctaaagtatctgttcatgtcttttgctcagtttttaatggtttttgttttttgcttgtacatttgtttaagttacttatagattctggatattagacctttgtcagatgtgtagttagaccattttaacttgtagatggcagagttgattttagcccataaaaaagccacagtaaaatgttgaatatcatgttttcattttcagatttgctatacttgaaaccacttgttccactgtaaaatgtaatcctttatgaattttatatttattgattcaaaggttctatgtttacattgccatgccatgtctaacaataaggtccacttgtaagtagatttatttgttattggtaacaataatctcacacaattttgatgtattcaggttaaaattttaagtatgataactttgctttcctgttgtagaaagattttaaaattaacattaatatgggtttatgcatgcctctattaaaatataatcagaagcaattattagatttccaataaataactggtttattgaataattacaactcacaggaagcatttacaaaggaattttataatgtctcccacattctttattatttgttcaagttggagaagttcttttcctgctctttgaaaactcaatgtaatgattttacgatcactcttaagtcataaaatgtcctataaatcatttttagttgccaaatattctcagttgggataataataaatctagcctggtaagaagccagtatccagacttcattgtaggttgataggccagctatatgtgtgtattaatttccttttgctacataacaaattaccataaatttagcagctttaaacaatactcatttatcatctcacagttttgtaggtcagatgtctgggctggttcaactgcgttctattcttagagtttcacatggctaaaatctaagtgttggccaagctgtgatctaattttagggctgtggagaagaggtcacctccaagtccattcaaattggtagatttcatttccttgcagctgcagaactgaaattcctgttttcttgcggtttttacctgagggtcactctcagccatcagagcctgctccatccatctggccctctccatctcagcaatgaagaattccttctgctgaccctctctctcgttttgaatctttctcttccctgccagctgaagaaaactctttgtgtttaaacaattcatgtgattgggctaggcccacccagataacctgcctattttaaggttaactcgttagtatccttaattacatctgcaaaaatccctgtactgtgtaatataacataatcacaggagtaacaccatgggctgaaggtcgtgggggccactttagaactctgctaccatagtgctggaggtcagcagtgggtaaggagagcatgacaggtatctctgctttccactgccatccctaagctttctatttattgttctgatttctctgctatgaggcagcatggggtactggggagaagaggatggcaaacaaataagaaaggaagtgaaaatgttcttaattgttactgttataaactgttttttcactatgtgtttgacagttgtttcaagctaagcctttctagtgagcaccttcaaagagttttggatatcccttaatattggggaatatttgcctgtaattccttaataaggtagtacattttcctccctgggaatccagagataacttcagatttcctctgctgagggtactttactcccagcctcctctctcactaatataccattgggactttatcctggctgtcttttacacatgagattatatgtggcctacataggaaagtctacatgggaagacactcctatattctttgtcctgacaaactttgagagggcaggccaatttctgagcagccacttatgtagcttgtttgtcaactgtcaactagcttttctcttaccttcacaggtctcaaggtgtagtcagacaatagtgtactctactgtggcttttaaattctcagaacgtatataaagctctccaggtgggctttttgaagatcccctctttcagttgaggtgatgaagaggtatttctcattacatccccttgcagatggtgaagcttagaacagaactcttcgagaaatctgcttcaaaaatcttctatcagtctctattctcaacatttcagtgtgcatgaaggacttgctttctgcttctccacatctattaaaaaaattggtacgttgttatgagatgtactgccttggattctgagctgattctcccactttttaattaccttgaagtattcactgtgttccacacattattctacatactttatatgttttatctaatcaaatgttcacaacaacccattgagaaatatgcatttaatagccctattttgtggatcaggagaataaagtatagaaagattaagtgatatcaatgctctctatcgaaaggtcatgggggacacttctgtggttgactgaattgggtttgttactcattgggatgagagagaactatggggaaccatagattgtctcagcaaaaggacattaaaagaatatgttggccgggagtggtggcttacgcctataattccagcactttgggaggcagaggcaggtggatcacgaggtcaggagtttgattaccaacatggtgaaacccaatctttcctaaaaagacaaaaattagctgggcatgatgatgtgcacctgtagtcgcagctactcaggaggctgaggcaggagaattgcttgaacccaggaggtggaggttgcagtgagcctagatcacaccatttcactccatcctgggtgacagagcgagattccatctaaaaagaaaagaaaagaaaagaaaagaatatgttatagaatttgggttttggttgggtgatttgggaagtagcctaagaatgtagaaatttgttcttgattgaacgctgtcaaaaaacaatatatcccaataaatcttaagttttggaagggcagactagagtgaagataaatatgtaattaataaaaaagtagattgggcatggcagctcatacctgtaattccagcattttaggaggctgaagtgagaggactgtttgaggccaggagatggagactagactgggcaacatagtgagaccctgtctgtacaaaaaatagtaaaaagttagctgggcatggtgcctcacacctgtagtcccagctacttggtggactaaggcaggaggatcccttgagccaggagtttgaggctgcagtgagctatgatcaagccacttcactccaccctgggtgacagaacaaaaacctatctcaaaaagagagggagagagagtgagagagagacagagagagaaagagaaagatagcacctgcttctattagccaaaagaggggtatttggtattttgtaggcatcaagctgaccttgcttttgtctgtgcttagacaaaattatgaaatgaccttgcttgtctcattttatcatgctcatggacaacatatctgagggttacattctgtgcaaatctgccataggagaattatgtggccaactgaaaatgccaggcccgcttccaaatgtcagattcggcttccctcccctccttcttttccttctcatgacttgcttaatattacagagctattaaggggtgcaaccaggaatcaaaccctaacactctgcctccaggatccatattacaacaactatactttactaacagtttaactgataactcaataatttttttaatccattatccttatgtagttattttattccatatattttagccataattgtataaattttggctagatttttggctaaatgatatttaataatggccttcaatgttcacatgtatttaggaaggaaacatatttttcttttactaggattcattacattgatatagctaagaagccctgaactcaagtgtaagatttggtttcctaggtcaattctaccattccgtacatgctgtttgagtcatctatgttcttttttgtgattgaaaagagttccagtgtatatttatattgtgttttatacttacctatgtaattacctctgctcatgctctttatttttcatgtggaactgaattaccacattctatccttccttttctgtctgaagatcttatttctcatacagcaaatctgcaggtgacaagttctctcagtctttatttatctggaaatgtctttatttctttttcatgtttgaagattagttttgttagatttagaattcttggctgatagtctttttctttcagcactttgagcatgttattcctccttcttctggcctctatagtttccaatgagaagttgctgttagtaccattgagtatcatttgtggatgatttgtcactttcctagtgctgctttcttttttttttattattatactttaagttttagggtacatgtgcacaatgtgccggttagttacatatgtatacatgcgccatgctggtgtgctgcacccattaactagtcatttagcattaggtatatctcctatatgctatccctccccactcccccgaccccacaacagtccccagagtgtgatgttccccttcctgtgtccatgtgttctcattgttcaattcccatctatgagtgagaacatgcagtgtttggttttttgtccctgcaatagtttactgagaatgatgatttccgatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgtagtcctttgggtatatacccagtaatgggatggctgggtcaaatggtatttctagttctagatccctgaggaatcgccacactgacttccataatggttgaattagtttacagtcccatcaacagtgtaaaagtgttcctatttctccactactctccagcacctgttgtttcctgactttttaatgattgccattctaactggtgtgagatggtatctcattgtggttttgatttgcatttctctgatggccagtgatggtgcgcattttttcatgtgtcttttggctgcataaatgttttcttttgagaagtgtctgttcatgtcctttgcccactttttgatggggttgtttgtttttttcttgtaaatttgtttaagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttagtccatcttgaattaatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagtgtgatgcctccagttttgttctttcggcttaggattgactgggcaatgggggctcttttttggttccatatgaactttaaagtagttttttccatttctgtgaggaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtaattctccttgaagaggtccttcacgtcccttgtaatttggattcctaagtacttctaactcattttatgaggccagcatcatcctgataccaaagccaggcagagacacaaccaaaaaagagaattttagaccaatatccttgattaacattgatgcagaaatcctcaataaaatactggcaaactgaatccagcagcacatcaaaaagcttatccactatgatcaagtgggcttcatccctgggatgcaaggctggttcaatatatgcaaatcaataaatgtaatccagcgtataaacagaaccaaagacaaaaaccacatgattatctcaatagatgcagaaaaggcctttgacaaaattcaacaacccttcatgctaaaaactctcaataaattaggtattgacaggacatatctcaaaataataagagctatctatgacaaacccacagccaatatcatactgaatgggcaaaaactggaagcattccctttgaaaactggcacaagacagggacgccctctctcaccactcctattcaacatagtgttggaagttctggccagggcaattaggcaggagaaggaaataaagggtattcaattaggaaaagaggaagtcaaattgtccctgtttgcagacgacatgattgtatatccagaaaaccccactgtctcagcccaaaatcttcttaagctgataagcaacttcagccaagtctcaggatacaaaatcaatgtacaaaaatcacaagcattcttatacaccaataacagacaaacagagagccaaatcatgagtgaactcccgttcataattgcttcaaagagaaaaaaatacctagtgctgctttcaagattttgtttctgttttttgataatttatgatgggccctgttgtagatatcttttagtttatcctacttgcagttttcactgaggttcttaaatgtatactttgatgtttcccatcaaatgctagttttctgtcattatttctggttcctcactggataaaaagtaaatactttataatgtttgttcccactccactgatttccaaatttcttcagaaactctgggttgattttctgttttagagtcaccataaacgtggtctccaagattaagttcttagaagattatgataggtagaaaagagtctatgctgttataaacattgatgacattgaaaatcaatctagtaatagcttttttgttacataatactttatttgtccacaaataagtggcctcttttctgatgctcttacctatcaatgattattaaaattctcaaacttttatgtggcaacgttcttaataatttaagttcaatcacctcatatatggcaaattttcactagatgtctagaacaaatttatttctgtatgtaaactatgcttcctttttatagatggtataagccatggtattttccactttttgtgggctcccaggaagagcattgtcaactttgcatataactgtggtagcttcctttacctaagtaaactcctgtgatttttttcttcctgtttctgtctaccttacacttctgttactttaagtagttttaattacatacttatatgatattttttattatagtagttagattataacttttaaaaattatgaccatttcaagtatttggatgggtgaattcttccagtaataaataaaggcatagtttacatatttttaaattggaagttgtgggtttaattattggctcttatttttctctcaagaaaaaaagcaaatgttattgaaaagtagacttttctgcaaatgatgattaatgaccaatgatacttctactgacccaatgatacttctactgatacttctaatatagcggtattagtttaatggtgaagccaccaatcacttaggtaatattgaaatatattgttgaccctaaccacaagtaacataatttggagtgctgctaggcagaattttttaaaggcattatcacaaacccttgctgcatctctcgcttacctaaacatgaaacattttgagaccaataattagttaagttttaattcttaacattcacaggttttgattttatactcttgtaattatgatgccttaaatgtaacttgtttttcagcaaggactttagatgactggtatgtaaagttgtaggttgtatatcttcatttaggaaatagtttgtatgctccaaaagtctaattgtctgtagatgaaagaaaattacaataaatgttggcttataggaattgccaattcaggccaaaaagcctaactggtttagcaaacaatattagtcagatatcaagttcaaaacaaccaaatgttatatgaagaaaaagtgtatttttaggataagtttatataaaatttcaggccaagtttctgtgtaaaccttaaacttcaatatttttagatagaacccaagtctatgcctgtacaaatgtaattttataaacttgttatcacattctatttcatgattaatttaaatatttgtattgcaaaatattgcttaattgttagaagctacaacagttttcatctgatgaattcagtgttacagctactggtaattacaactaggcttttatagtatatacatttctctcctttggttgattatattgtttggcaaaactaatcccctaaaaaattccttacaaaataattcatcataaaaaaagaaaatcagaatgtaggcaataatgtgccccatcaacatgtatatgacagctctttccaatatatagcataaccactgaaatataatcatcattgtgaatatttaccgtgcacttcatctgtcttttactgtgcaatagtgtttttcttgggtatttctgatatcaaatccttgtggattgctaaattttgattttcactcaatttttaggaagcctgtaataaaataaaatgtgtttcctaagaaatttgataaaatttacagagttatgcacaaatgataaaaaataccacatttaagatagttccttaaatcaagatcctaataagggcaactttagtataacagactattactgaggattttcattttcattgcccgtctttacatacccagttgggttctagactggtacaccttgtatggaagagattagttagagactgaacaactctctcttttgtcttcattagtactggggcacgttaaatttcccagcctctctagcagttaggttggagccatgtaactggctctggttaatagaatagagggaacatattattgcctggccatgaaatatatgatttttccatgatctcactcactgtctggaagtcaagtactccaaaatagcagcatcacgtgatgatgagaacctagaccttggaattcttttcttggatggaattgctcagaaaaatagcttagctagaaacatctgtattggactttgtgtaagtgacaaataaacatttgttgaattaagcaaccaagattttagtttgttatagcaactaccaagtgctacactgagtcatacaactggcaaaaatgcaaggttttctgaggagttctcaaaacaagtaataatttctggattagaacataaaataaatatgctttttgtgattattcttttgtccttaacatttataaatcttccactcaaaaataattatacagtacatttagaaatgaaaatatatgtgcataaagaagatatacactattgcatctaagttttagtatggttttgaatagtactattataagaacaaatgtacatgaattcagctcttagttttgtaattaatgcactttcacaatctctgacaacactgtttttaaaaacagctgatagtttagttacaaatttccaggaacttagcaaatgtcatagggtaagctgtgtgctgtctgttaacacagagagaggtaagtggaatttagcacatttcaaagagaaagcaaaaagttagacaaaccaataatcaaaattaaattttgtaaactatgttagataaatgcccaccaagagttaatagaacaaggcttagaaatatctgtagataaagttatcagtgactttactgagaaagtttacaataaccatcttttccgaagccatagcattccttataagtttttatatatagtttaggtatcacacagattctattttcttaggctatcataggaaccgaatcaaggttattagattggaatattggtatagaaaccattccaaagcttcaaagaaatgaatgaaattcattatgtcttgcaagacaaaacttccatctcttatttttaaaatgtctgcttaaatgaaatccccaaaaattacttatagttaccttatatgagaagttaaatttgagttaaagttttcaagttcttttgcaaaggtacactgaattccgtcactaaatactttcctaatatgcttttggaaaatatattcaagatcctatgtctgtcttttccttttttcaggccttggatctactcagactatgttgataaaagataaatagatctcttgcaggaagaattgtactttctgcgataaaaatttaatgggctaatatttaattatgttggttggcaaatttaaaaattatgcaatatgaaggattataacatcaaataaaagcagagatgaactttttagttcaaagattcagcagcttgttctatcacttactgtagactgtgactgtaaaggaaatatagtttagatgagctctcagttcatactgcttcaatgcattaccatgggctgggtggcttaaacaacaaacgtttattttcccatagttttggagggcaagaaatccaagatcaagtccctggctgatctggtgtctggtgagggtacattcctggtttgcaaaaatagctgtcttctccttgtattctcacatggctgagaatagagagcaagctctgacaagggtactaattcctaagggctcggccctcagcacctaattacttgccagaagaaacctactaataccgtcacattggacgttaggatttcaacctatgaatttttgagggatgtaaccatttagcccatgacacatgctaacttttttaacagtaaaaaccggcctaaaaataattatcttctgaaaatatcctgacagatgtgaaaccacatagcaacatgcttcgcacacatttggacatatgtattcatagagttctatatttgggtacttccatagaaatctttaatagctaaagcagtgattatttactatattaaagtgtttttctgcattatttcatttcatcttaatgaaaatcttagttaagtttattaaacccattttataggtaaggcaacaaaggcttataaagcataagtaacttgcacaaatacatagaaatttgtaagtattggagccagaattcggacccaattctgtccaaatcccatctcttactcaagcttcttattttatagattaaaaatcagaaccttagaaagaagaaataatttacttgaggacacatgtctaaccactgttagagcacatcttggaacccaaatattctggctcatatacaatactaagtgttgatatttgtttgttaaatttattttttttcttttttttttttacatttagaaaactccaatttttatttttatttctttattttattttattttatttcttatttttatttttcgcagataatttttgtaattttattttatttatttttttatgattattatttatattattattatactttaagttttacggtacatgtgcacattgtgcaggttagttacatatgtatacatgtgccatgctggtgcgctgcacccactaactcatcatctagcattagatatatctcccaatgctatccctcccccctccccacaccccacaacagtccccagagtgcgatattccccttcctgtgtccatgtgttctccttgttcaattcccacctatgagtgagaatatgcggtgtttggttttttgttcttgcgatagtttattgagaatgatgatttccaatttcatccatgtccctacaaaggacatgaactcatcattttgtatggctgcatagtattccatgttgtatatgtgccacattttcttaatccagtctatcattgttggacatttgtgttggttccaagtctttgctatcgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcactgtggtttcgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggactaacgtttaagtctttaatccatcttgaattgatttttgtataaggtgtaaggaagggatccagtttcagctttctacatatggctagccagttttcccagcaccatttattaaatagggaatcctttccccatttcttgtttttctcaggtttttcaaagatcagatagttgtagatatgtggcattatttctgagggctccattctgttccattgatctatatctctgttttggtaccagtaccatgctgttttggttactgtagccttgttgtatagtttgaagtcaggtagtgtgatgcctccagctttgttcttttggcttaggattgacttggctctgcaggctcttttttggttccatatgaactttaaagtagttttttccaattctgcgaagaaaggcattggtagcttgatggagatggcattgaatctgtaaattaccttgggcagtatggacattttcatgatattgattcttcctacccatgagcatggaatgttcttccatttgtttgtatccgcttttatttccttgagcagtggtttgtagttctccttgaaaaggtccttcatatcccttgtaagttggattcctaggtattttattctctttgaagcaattgtgaatgggagttcactcatgatttggctctctgtttgtctgttgttggtgtataggaatgcttgtgatttttgcacattgattttgtaaactgagactttgctgaagttgcttatcagcttaaggagatttggggctgagacaatggggttttctagatatacaatcatgtcatctgcaaacagggacaatttgacttcctcttttcctaattgaataccctttatttccttctcctgcctaattgccctggccagaagttccaacactatgttgaataggagtggtgagagagggcatccctgtcttgtgaaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctagtagacatctacagaactctccaccccaaatcaacaaaatatacatttttttcagcaccacaccacacctattccaaaattgaccacatactgggaagtaaagctctccccagcaaatgtaaaagaacagaatttataacaaactatctcttgtttgttaaatttaaaaaaaatccatgagaaatagatcttgatgactagagaactgcattcatttttgatgaagaaataaaagggaaaacattagcaaataatgtaatggtcataaaagtgcatattaaattaatgatgaaacattattgcactgtcagaataccagtaattttttttaagaaatacgtttataatatttgtaaaattacattgattgaatctgattgttttatatataaaaaatgaaataattttctaaaaaatgaaataaggaagttgaagtagaattataaaaacacaggtataatacattatctagagcttagtagcaaatcctaagcaaaattctgagtaaaaggaaaatacacgagaaatacttaaatatgaccaaatgatttaccagaaaccagttagaaacatttaccaagtggtaaaatctagattatgacaaaaatttcagacatcatccactggtgccacttgggaggttttagataatgcaagacaataatataaactagtaaggataaacttagacaaaggaaccaaatatctgtgtttgcttattataattacatacacaaacaagagtatttatataattaccagctaaaagattaatataatttaataatttgtgctaatatttgaatattaaaatgtcaaatgtcaagatagaaatgcaaaatgtaatagcttctctacctaaatagtatacagttagaaatggacatgataatacttaaaaataagatcattcttggcacccttgttgaatatcagttgatcatatatacatggatttatttctgtattttatattgtgttctattactctgtatgattgtctttatgcaataccatactgttttgattactgtagctttgtaaggtattttcaaagcaggtggtgtgatgtctccaacttcatccttctttctgcagattgatttggttatgtgtaattttttatggttccatatgaaataaaaaattgttttgtctatttctgaaaaaaagcaccattaggattttaatagaagttttattgaatctgtaggtctcattgggtaatagggacattttaacaatattgtcttccagtctgtgaacgtgagatgtcttttcatttgtttgtgttctttaatttctttaattggtgttttgtagttttcagtaaacaagtcttttacctccttagctaagtttattctaagtattttattgttttttaggactgttgtaaatggggttgttttactaatttaatctctacaaaaatagcattggaaaattggatatccacattcaagaataaaattggacccttaccttgcactgtacttaataatcaactaaaaatggattaaagacacaaatgcaagaattgtaactgttaaactcttagaagaatacgtagttaaaaatattttcacatttgtcttggcaatgacttcatggatgtgacaccaaaagcacaggcaacaaaaacaaaccagtgagaccacatcaaactagaaaacgtttgcacagcaaaggaaccaatcaccagagcaaaggcaacctatagaatgggagaaaatatttgcaaaccgtgcaactgataaaggattaatctccaaaatatataagacaatattccatttcaatagctaaaaataataactcaatttaaaaataggataaagacttgaatatacatttctctaaaaaagacatacaaatggccagcatgtgtatttttaaaatgtccaatgccactaacaggaaaatgcaaacaaaaccacagtgaaatattacctcatacctattagcattgcttatatttaaaaacacaaaagagaagtgttgacagggatgtggagaaattggactttttgcactctgttaatgggagcacaaaatgatgtagccactatggaaaacagaatggaagtcccttaaacaattaacagtagaccatatgatctagcaggcccagttctagatattttctaaaggaatttaaattgggatctcaaagagatattagcagtaccatgttaattgcagcattatgcataatagctaatatgtgggaaatctattgacagataaatgaattaaaaatatgtacataaaatggaatgctattcagccttaaaaaggaaattctgcaatatgtaataggagagatgagccttgaggacattatgctacatgaaataagccagtcacagaatccccaaacctgaccactcatacgaggtatctaaaatcgtcaaatttataggattaaaaagtggaatggtggttacgaggggttgaggcatgggaaatgggaacctactaatccatgggcataaagtttcagttacacaagatgaataagttctatggatctgctgtacaacattctacctatagtcaacaatattgtattgtacacttaaaaatttgtgttgagggtatatctcatgttaagtgttcttaccatgataatataacattttaaaaaataaatagaagagtgactcaaccacagagagccagtctatattaaaaaactataaaaatgttattaaataatagaaaacaaatatagacatataatttaacatttgattaaaaaatgtcaccttttccaaaatgttcatggaatttaatatagctctgttcagcattttggcatttcctatggaattctagctaactggttagatacaaaataggtaagatgattttacattcatatgaaacaatgactgccaacaatttagagaaaataattatcaatttaaaatatcagcaagaaacataatattactacagaaaacataatttggttagaagagaggatcaaatcactccatataattatagaattttccttgtggaaaaatgatcactctcaaatgtcattagagggggtgtaaagtgttacattatttctagaataagctctgacaatattatttttttcttttaaagcataacccctctgactcagcaatgtaattttagggttctattctgtaggaaaataattaccaaaaatgagtatttattatgtaacttcttgtttgtttgtttgccttttgcagtggcctagatctagaaacaacctcagtgaacattaattaagaaagtattgactaaataatggaataattgcattctggaatactatcaaactaccagcaatgaatttg

SEQ ID NO: 964 - DNA, 1101577 bp, Homo sapiens
  misc_feature (686217)..(786216): n is a, c, g, or t
gcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcagacccccagggctcttctggggaaacgcggggagaggtggtcacttcggccagggaagggccactgggccctggcgcccgcgccggcctcggtgctccgagtccccggaactcgagacctgttgggtctgcggagccttcggtgctctcggggcaggcgccagtcgctccgctccgttccagacgccgccgccgggcgggaccctgctccctggattggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttcttgcataaacaggatagaaacgtgtatggagtaatgctttttcattaaatgcccaaccacatccatcattcctaacttacgtgatgccatcatgtgctagggaaacctgtatatttagggctgaggctgaagttaaggattgaggttaattatactgataaggcaacattattgactcattacatcaatctaccgccaaataagtttctacttataacttgcatggcatgaaagagccaaatcttcatattacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgcaccagcatactatctgatcttgttttgttttagtaaatgggtaaaagaaataccacaggtggaatcagtttagaacttttttttttttttttttttttttttggagacagagtctcactctgtcacccaggctggagtgcagtgcagtagcgcaatctcagttcactcctcccccagggttcaagccattctcctgcctcagcctctcgagtagctggggactacaggcgtgcaccaccatgcctggcttttttttttttttgcatttttagtagagacggggtttcatcatgttggccaggctggtcttgaacccctgacctcaggtaatctgcctgtctcggcctcccaaagtgctgggattacaggtgtgagccaccatgactggccagtttagaacttctattttaatttttttttttttttttttttgagatggagtctcactctgtcacccaggctggagtgcagtggtgctatctcggctcactgcaagctccgcctcccgggttcatgccattctcctgcctcagcctccccagtagctaggactacaggcgcccaccaccatgcccggctaatttttttgtatttttcgtagagacggggtttcgccatgttagccaggatggtctcgatctcttgacctcatgatccacccgcctcggcctcccaaagtgctgggattacaggcgtgagccaccttgcctggcccctagaacttctattttaattcttgagaagagtctatttcataaacttataatactgtgagaattcacagactaaccatgccatattcaatctgtaatttaatatactaagagataaatattttttacttgctcgaaacaaaaattatttttttaaaaatagctgttattttttccataaaatctacatttcagagttccaagggaggctgatgtgcactttttcaacctaatcttcctttattgctgtttggttgatattctgcttgtttaacagaggtatatactcttgcaataggttctgaggttaatgggaaatgtcatcagaagggtgttgcttcgtgctgaattcccctactctgtccatatgagcttttttcagacattgagttgcttaatgaagttggagtaaagattaaagactaaacatcttggggactgtcctgtgacccttggcgtctcccccttccttggtgtgtgcattggtggctccaccagtatgtggtgggtaagtgagggctgtgcaggcccatggtgactacagcagtatcagaggaggttcagacctaggacacaaagcatcagaggtctgcaagccatgttgatccttgagaatcccactgttgattgttgttggttttaaatgaaagtggctgtcttgagttccctgtatagggaaagctggagttcttccttgtgctcactgacactggttttaggcctttggtcactggttgatgtatctatggcatgacgagcctaggatcttttcagaactattgtcttctcttttctatgttggataaaacatctgaatgtgaactttccacagtaagagttctctttcgggcatttgaccgttttgctgattcagttaaataaagcagaatggcattccagcgatgatgctgtacttgtaattagcccaggtgagcagaggctcgttgaggtttttagataagtcatgagagctcgtgtgggacacaaagcttctattatttttttttttctgagatggagtctcactctgtctcccaggctggaatgcagtggcacagtctcagctcactgcagccttcacctcccaggttcaagcaatcctcttacctcagcctcccaagtagctaggattacaggcatgtgccaccacacccagttaatttttgtatttttagtagagacgaggttttgccacgttggtcaggctggtctcaaactcctgacgtcaggtggtctgcccgtctcggccccccaaagtgctgtgagccacctctccctgccaaatcttctattattgaagtctgtggggacagcatttctaggagtgtggccttcagtaatgcaatatttttcctctgtctgagggtacttggtatcagattggtcacttggtaacaaaatgcttggtgctggttctaaatgggagcagtgtagcacagattttgagggaatttgccttctcaaaatgggttccaaaaattctaaggtcacagttttctgagagttgtcaccatgtgtcccagtggtgtgatacttaggttggtctttctctgcttgctagttgttcaacatcccttcataaaatcatcacccttataactagacgtttcttgaaatattgattaatcccatctgtgcaggaaacagtagctaggcatgggtctgtttcataatcctccttgcaggatttataggaatggggatactttaaacatgtttatggcccattaaaaaatgcagatttccagaaagaagatcccaaagccagaggtgatcagcacaggatgttttataaaatttcttcaataaaactgtagtgaagagggctgtgctgttttttcacagagctctgtttagttctttagttcatatatccactgggtctgagtttttcaacatataaatgtactaaattggctcttccctgttgcacagccatcatctccttttctgtaacctgtcctggtcagtaatcacaatactgctaacttgatcatcatttggactttgaaccctctgtgctattaccaagaggtgtggtgcttattgaaatatgaacatctagtattcattcgtccccatggacaagggctttgcacaggaagcatttgagcggatgaattcgttaaatgaatggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcttctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgtggattttattaggaaaggaaatgttacttactgttttggaagaaaactcattggccctggagaagcttttgagagctggcaagctctgattggtgagttgactgtggtaggtaaagctagagtcactgcaggttgtttcagcagttactaggtaaaactggtcttagaggtacagcaggctgtttcagcagctgagcttgtgggaaatttaattcttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaattcaattgtcctcctttcctttttcttcacgcccagaaaaaattaatcttcttgactgaaagatactctattatgtgtctgaggtccccccgaaaagttattacaaacccaacagggcaagtagaaacaaggagggtgatagaagaaagctgaaggctgccctcgaccagcagaagttgttctgggatttgcaatggcctctgaggggcctctgcaggcagctccctggactgctgtttcctcatgtgtcgaataaggaaatttgaatagattgattattcttgaagtccctttcaactccctctcccagttaagggtagcctcattactgtctcctcaacattgctcttaggacatgctttagaagtcaccttccatgccagaacaaatattttgttggcatcatgatttcttctgcattgacttatgtggcatctctcagctcgccagtcttgtctcagcaagcatgccactgtatacggggaaaacaaatagatggcatcaatgtatagtcctattggacacaaaatctagagcattcatgcaccagccttgatgacccaggaagactgtatatgtgtgtgtgtagcacaccatatacatgcatgtgcatgcgtgcacacacacacacacacacacacacacacacacacaatgttcatacatctcagatgtaaaatactggcaccattgtccagcatagctgaagatctgttggataagagctcctgtgggtgcaatcactttgactgcttggctttcttggatattaaaaaaataaccacactgtaataaaacaggagtgccaaggatgttctggtttccagtgtggtgttactcgtctgtgaaaataaaagtgaattgctggctagccaggccggccacaaggcctgttttgcaaggcaccaattggatgggatgggactgcactgggtctcactacgagaggtctaaggctgagcacattttcttcactgatattggtatttgaaaagtgggattttcttctctttttccctctcctactggactaatgcccctattaagccacacatagttttattttaaataattctcattttatggtattggtcctatataaacaacttttagtaaaacctccactgacagaaactcaactacaaacttgagcaaactggactaacagtctcatacgtttcattacattaatctaaaaaatggtacttctagggtatgttctgacttcattatacattcagcttaatattctataccttcttgtcctatatttttgggaagtgagaattaataattttcaagcctaaaggccaaatttttttttcattcttataaaaattattttgattgtggactacattttctatgatgaggtaaaaatgaattaacacatgaacaatttatctttaacaggctgggcacagtggctcacacctgtaatctcagcactttgggaggctgaggtgggaggatcacttgaggccaggaatttgataccagcctgtgcaacatagacagcatctctacaaaaaaatttttaaaaataattatccagaagttgatattatattatgtggctgtcatcctagctactgaggaggctgaggcaggaggatcttttgagcccatgagattgaggctgccgtgggccaagattgtgccaatgcacttcagcctgggtggcaaagcaagaccccgtttctttaaaaagtaatacataaataaatatacttatttataacagaaaatcaaagattatcttgttaaatggtagttttctagaaaattgcatttatcagaccaaatcatatcttgagcaaactttttataagagggttctgttttgttatttttcttcctatgactctgtaaattgtgcatctatttttttaagatctccaccctttcatttcaaacttaattatattgataacttatagttgtagagaacttacacagcttccaaaataattttgtctgtgctatgttattatgttagaacaacccattgtgttggaaagacagatattagttctttttttatggttgaaagagctaagattttgagagagtatatagtggggctggttatttgaggaggagctgaggtgctgacccatttccagcccaggttctttgcacaccacaatgtattctttcagaaattatcttctttccagttgcaactgaaaagaaacatagtgcctggaagatgggggagaaaaataagagatcaagtgggagagtatgtcttctgctctatcctcataggatttctagcctctgctggaacacatccaaggactggaaacttgtgccattgttgacaagttctgtttgttaaaatggtatttcttaagttcggaagatacatatacatacctccattgaactttcacctacagttttagcttgaagccttttaactacaaaaattttcttatccctacttcacatgacaacctttcaagtaagttccaacagttgccatgtgaccccttcatagtctcttttctagggaaaatgtctctatttctttcaacttatatatgaaagtttgatcagggtaactgtgaatttaacaacaagacaccatattttttattcaatcattgccatcgttatctgtttcttagcttccacaaatttcttcctatttattgttgttgatttgatagtcttcatactgttttccacagtggctgtactaatttaattcccaccagcagtgcacaagtgttcccctttctccacatcctcaccaataaatgctacttgtttttgagccattagtgaactgatagaaaacagcattctggaccgaaaaagtagattgtctccaaaagctgtgtggataaggagcaatgaaagaaagataataccaaggcaaatacctggaggatgtgaagccaagagcatcagaggagaaaaggaaccatcaagaggttggttagtgggtacaaacagacagatagaaggaataagttctcatgttcaatagcacagtagggtgactgcaattactaataatttattgtatatttcaaaacagctaaaagagtctgggtgcagtggctcacacctgtaatctcagcactttgggaggtcgaggtgggagaattacttgagtctaggagtttaagaccagcctgggccacacaacaagacgccatctctaaaaaaaatttaaaatatgccaggcttggtggcatccacctgtagtcccagctacttgggaggcttaggtgcaaggattgcttgaggccaggagttcaaggttaaagtgagctgtgatggtgccacggcactccagcctgggtgacagagtgagaccttgtctgtaaaaaaataataataattagaagagaagatttgaaatgttcccaacgtgaaaaaatgatcactgtttgaggtgatgaatatcctaagtaaacatacatcaaaatatcacatgtacctcataaatatgtataattattatgtatcaacaagaaaatgaaaacgagaatgttgaaacaggtggaaagatattcatatagagcctttgggaaatgctagtcactggacatgggaggaaaatggccgtcttcagttgcggtatcagaggccttccacaataagcagtgttaattggcaaacaggggctatgagaaacacacaagtgatgaaaaccagccttatttctactggaatctcaggtcttacctgacttaccaccatctaagtttgcatagtcacctctaaaagtgtgagcatcttttctgtgctttgctggtttgtatataacttttattcagatatctttcactctaataagtagttctttgcattctgattagttggctttatgaaataagtcaccattattcaagaagggaaaggcgagagacaaaggcattcggcttccattagtgtttggaattacagccacacacaaattaagggtgaatgaaaacaaatgccctcctgtagctgctgctggtattcctccccacctcctcttcactctctctcctcctcctcctttttctccttctcttatttatcctcctcctcttcttccttctcctcttcctcttccttctcctcctcctcctcctccttctcctcctcctcctttgattatcttaagccagatgtgtattcttacccaggtttgtgatatgtctacccttgcctttatgttgggaaacgtgaggaagctgagcccagctcccaggacagtttggtcgcctctaatcataccatccagccataatctcaggctgaaggaaatcattcattggcactaaagagagctggggagatagctgacagaggaatgcaatggatcgtctcgctcatccaccttttgccatttgtttgattttttcctgcaatgtgttttcttctcgtcaacttggccggaatggtggtaaatgctgtttttatatgtggacttacttgaaaaactgatctatcttagtcttggactttgaatatcattaaagttctccaaggaccttgcaaatagctgcttgccaaacacaatagtttaatataatttgatctctcactgctgcttagcttctgagaaatgtgttgtgctcaaagtgttcaagcattaattaaaattgagagcactgaaattgtcagcgcccactgactccatgtgagtgtgtaggtgagtgtgaatgtgtgtgcacaggcaggtgcaggtgtgtactcacatgcgtattaacgcttaggaagctgaactttgcttctttctcattaagagttgaaggctattatctaatcatgaaaataaaaactctgatggaattaacttgatgttgactctcagtttgatttctgaagataaaccagagtcatctctactctgaaatattaacgtattctagagagtggttcccaacatgatgtgacgctggacctgcgttatcagcatcagctgggagctttagaagaacaaaatcttgagcccacccagacctactgaatcagaagctcagagggtgggtgattctgatctgcattaaaatttagttctaagtgtacccattcgcaaactctttgtggtgaagtgccagtgatttcatttttgtttttaaaatttcgtggctcagtactttctcccatctttctgttttttttttttttctgagccctacaaactttttcaacctctgccctaaagctgctttcagattttcaggtatctttgtagcaatgccccattccttggtatgtgttgctataaaggcatacctgaggctgggtaatctttaaggaaaagaggtttattttgctcacggttctgcaagctgtacaagaagcacaggcaccagcatctgcttctggtgaagtcctcaagctgtttccactcatggcagaaggtggaggggagccagtgtgtagaaatcacatggccatagagggaacaagagagagaggaaggaggtgccaagctctttttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacagaagacagaccctcgttgtttctttgctgacctagggaattctgcaaagcagaaatatgaagaatgaagatgctgactctttacagacagctttatttaggtgaattcaggttgttacatggtcttgccacaagtgcatcttattctagaagttgtctgactacttcaacatgcatttctttccttctttcttccttgagctccttaatattaaatgcaaatgaggggaggcgtgttgaagttacactaaggtttagttgtagcaaaaatgtgctttgtgcacctactggaaattcccttgtggaatctttatagtaaagcctattggggaaatataattgaaaacaaaatcttcttccaacctagaaatcctctccacaaaggtagtagagaaagagaacacttttcttatttgaataagcattaaaccagaatggtgatgcacatcacagacaagatgctaaaagatcacaaagacagaattctcttatatagccaggcagatgcaacccattaaatacatgttttcaagataaacagtagctcaccctgaagtaagaggatttgacagcatcatttgtcaaatagttcatcctaactttactagctgcttactggctttatttagaggggggaaaagcctctcatatcttcatgatagaaggtagttttgcatattagagcaaagtgtccaccgatgttaggctccagaaactgggagacaggggttctgtctcccttgatgtttgcattttaaaaagatggttccagatctttgggaacaagatccccgggtcataaagctaacaaaagccctccctatctagtcttcacaaggatgcacttccaagagatgaaaaagtgcttataggccgggcgtggtggctcacacctgtaatcccagcactttgggaggctgaggcgggtggatcacctgaggtcaggagttcgagaccagcctggccaacatggtgaaaccctgtctctactaaaaatacaaaaaattagctgggtgtggtggcaggtgcctgtaatcccagctgtttgggaggttgaggcaggagtatcgcttgaacctgggaaggggaggttgcagtgagccgagcttacaccattgcactccagcctgggtaacaagagtgaaaccccgtcaaaaaaaaaagtgcttataattacaagttttcttaggtaaagctctaagaaaaaggagaagaaaacactttcctcctgattttcaacaggaagaagtaagtgtcttatttctagcttgtattagtccttacaagccagagcattcaaatgagtaaccgctacaatagccagcaaagctacagacacccagtaagaggaactggagcctgtcccaggcttgcagatgctgagtgctcgagatgttgacacaatttagccaaaattgaggatcaggagactgccaaggacaccggtgcttgatggaactattccctcttccaagaatttaagagcaagaaaaaaactcagccatatacttggagcagtggctttcatattcaggactaggagcatttgggttctgcaggatgtgggatggaggcatggctaaggagcagccataggggtgatcggagtggccacaggggtgatcaggcctgaaaagcctgccactcagaagcctttcttccaagagttgtttattcactgcttagcaatgagatcagcactttgcctgctgcatctcacaaagccctctgacaaccctggatgaaggtactaatatctttagttttcaaatgaggctcaaagaagttcaatgagaaaactgcccagggtcacctaggtagtaggtagaaaattagtatcccacttagatgtgtgtcactgtgtcatctgaagagaagagattaagcattgggcttgctagacaacaaggatactcttcaacatataaacaatcttattcaataaaatcttattaatgccctgttgactgaggttgcattaagagcatgtggaagcttatccgatgtttccattctctggtctctacttgtgactttgctttttattttctcttctgtgctggaagtgctggaaagcacctcatcttttgtcttttcagttgttggatttaggttccatgattaagggttgtgttgctattgttttcagtactttgttctctttctgtatcccaggaagtcagcaactgggccctgtctcctacagaagcaggaagaggactgagggttgagggacttttggtggttttctaaaactgtcaatcatcctatgtgtgacaagcagagagtttcctgtatctctgttgcctaagcaaaggagcaggtgggaaagtattttgctaactagcgatctaagatgaggtttttgttgttgttgttgtcatttttgagatggactctcactgtgttgcctaagctggacggcagtggcatgatcttgactcactgcagcttccacctcccaagctcaagcaattctcctgcctcagcctcccaagtagctgggactacaggcacgcaccactatgcctggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaacagaggatctggttcgtatgattatgttgggagagaggatcctagtttctctggccagcctcgggagaaaatgaggggccagaaacagaagagcaggagggggagtggggagaaatgtttgcttctgaggccttcattttgggttatcattttctgggcctcagcaaaagcagattgagattattattatattaacataagcattgtggtctaggtttggatgtttctacaaggtgtttcgaagcgaatgactcagtgaaagatacaatgggtgagaaagatggttctctcacattgtcaatccaaggcagaataaaaaagtcataattaaaaatatttcttaaaggggataaaatgagtatgtattggcaatttgctactacagtgaggtgtttaaaaagagaaaaaaaattaaatgaaatgtaaaatgaaacctgggtatctataacttgtgaaggctgaggaatagaagatacttcactgagaaaaggcagaggactcccttgactaggtgtaaggatgtgctcttgagatgctgggaacaaggaagtccgtgggagcaatggggaggaccaacacacgagcagcatctgctttgaaaagtggagactgaattgcggtttgatcctgggagcaaacaccaaagaacttagagctaataatagcgaagccataggaagagcagcaacagagaagcttgggtggaaggacttcgaatacataaaagttggaacaaaataaaccaaggagacaaacggaagtgttacacaggtatttttctttataagagaaatatattttaagagcactaaagggcctttgagctcagcttttatgaagaaatctgtttcaagatagaagagatatattgtaggtttctgttaaattaatggcaaataccactagctaagacaaagctagtgcttaagagctaagcattctttattttaattagtttattcttatggatttaggggtacaagtgcagttgtgttacgcggatatagtgtgtggtggtgaagtctgggctttttgtgtgctcatcgctcatagactgtacattgtacccactgggtagtatgtgacaccccacactcctcccaccctccaatctttggaatctacagtgtctattattgcactctatacgttgctgtgtatccattgtttaactcccagttataagtgaggatgtgtggcttttaagtttttaatttctgagttagggtctcactctgtctcccaggctggggtgcacttgcatgatcttggctcgctgcagcctcggcctcccaggctcaggtaatcctcccacctcagcctcctgagtagctgggaccacaggcacatcttaccatgtctagttaatttttgtatttttttgtagagacagggtttctccatgttgcccaggctggtctcaaactctcagactcaagcaatccacccgcttcaggcagctagggtgtgaggattacaggcgtgagccattgctcccaaccccagtttttaactttttgttgtcgagcaatttcactaaggataatagcctccatttctacccctcctggaaaagacaagttttcattctttcatatggccgagtagtattccatcgtgtatacgtaccacattttaaaaatccagtcatccattaatagacgcttagattgcttctgtgactttgctgttgtgaatagtgctgcaataaacatgtaagtcagatgtctttttgataaaataagttattttcctttgcatagatacccagtagtgttattggtagatcaaagtgtagttccatttttagttctttgagaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaattcttttttagctgattgtgagtcagcaaaattcaaaacattgagttctttatagcttccgtgcatcaccacttgtgcaaggtactgtagaatggattcaatgtgcctgttgggaattagaattataaagaattttggaagtttctagtctgtcattgtttctggtaatgcatgctgtgaagggctaagaaatgtgttcatcccacagaggatgaaacaacagacttggtcaaaaaagtatagttatggtccttttaaatggaaaaattcagaccacagctggataggaacaaaatcctgaaaacagtgacagattcagtgtctggttattttaatactactcatgtgtagacatggatagaaaaatgcagatagtagagtaccaaaaaatacctattggaagtataaaaagaatggtaattaaatgatttctataggcacacagtctgataagagagagacctcattttatgtagctcttttactgaaaatgtggcatttatttttctgtattaattcaatgtatttcaaatgaactaaaaacctgccatcttcaaggatttcattatacgattccttatgaacactgtcataaaatgagtagttaactcatttaattttttgtgaatgaaaatatgaatggtcacatgttgaatttatttttatttttttacttttttgagacagagtcttgctctgtcgcccaggctggagtcagtggtgcaatcttggctcactgcaacctccgcctcccagattcaagcgattctcctgcctcagcctcctgagtacctgggactacaggcacgtgccaccatgccgggctaatttttgtatttttagtagagatggggtttcactatattggccaggccggtctcgaactcctaacctcatgatctgcccgcctcagccttccaaagtgctgggattacaggcatgagccactgtgctcagccctaaatttactttaaaagggttatacatgtgttggtaaatagcatcaagaaatacattccttctatgttatcgttattttaattctttatttttgtccccaaaagatttacttacagatcttggatgatcttgggtcttgaatgggcatgctgaggttctacctctgggcaggaagataggtgtgaagcaacctctaacagcttgtgcggaaaattacccccaggttagcaccagtgaggcacagttgttcagcagagcaggggctgggcattgttgtagagcagagccacgcccttccattccagagcacttggagcagttggtgtttatgctgctgggttgtttttattgaggacaaacatgcttttacatttatctatcttaaaaaaaacttaaaaactcacaagacaacttccctgatatgccctgtccccctccagctaccagtctttcccttgaataactcaatactataatgccactatttttaactcctcctcatttcctcttaaaaatctcccatctgactttggttcttaccactgcatggaagaattacctgtccacatcgcaaacgacctccttcccactatattcagtggtcagttcccacttaagtctctgaaggagctcaggaaatgacaccccaaaatacaccgctttggacttcaaacttccccagtcacttggtgaacagcaaattctgagaggagctttctgagtaccttttacctaccagacggatcctccagaggggacacaattgtcatgaatcccctccctagaacttcatcaaccagggactgctggctgatatcacaggagaggatattggagctgacactgcacccagacaggttttgtctcaggctgtcttctgtcctgctaaggggccattcacccgccctagaaatcatttactctcccctaagttgcctacatccaccctctctctcctatggagagggtatataagctttcggatgtctctgggtttcgagtattcatttttctttcatgtgatgctccgtgaatgtaatacacatgtatactttttctcttgttaatctgtcttaagtcaatttaatttgtagcccagccaaggaacttccaagagtggaaggaggccattttcacccttccagggcctggcagcacttttttgaccactttctttctttctttttttttttttgagatggagtctcgctctgtcacacaggctggagtgcagtggtgcaatctcggctcactgcaacctctgcctcctgcgttcaagcacttctcctgcctcagacccctgagtagctgggactataggcacgagcccacacccagataattttgaccactttctttattgagcttccaggtcacccttccctccatctcaggggctgcttatttccttttcctggctgcctctccagcccagggctcaagcatcattcttctgccttttcctagatggcctcattcatctacatagctttaagcagaatctgtgttctgaagacttctaaatttgcatgtcagcctctgagctttaggcttttacaccaaatttcccccagacttcacctctcacgtgcctaatgggtcataaaaaccagcagagccaaaacagaactggatttacctcttccacccctttctccctgggcttcctgaccttggtgcacagaaccattgttcatcctaatattcaggctctgaagcttgcagcgacctttggtttcgttctcacttcatagctcacagccaatccccacatcaacaagcagctcgggtttcagatgcatcacatctgaccacgtctcccctccctcaggggtcccagttcagtcagtgccatcatcctctcctacctggactgcaagtggactcttacttggcttccctgcttccactttgggtcagagacacatcatgtgtcctcagagacaaattatgagtccagagtgatcgttttagacacgggtcagattacttcactcactagctctgcactctgctaggataaaaccatatttcttactgagacactggctggctgatgtagaggcctccagcctgacccctagccttgctggggtctcaggggcacattgagtcttattgagtcccagctcctttgcacctgcttctccttccctgaaaccgtcttcacccagatgttggcttgctctttgcagagtgctcttcctgtagaccttcatgctcaaatcgttgtccacactctgtgccccttccccagtatcatgatccctgctcagtcactcgctgtccacaccctttcctttcactgagatcatagtgtatgtttattggttggcatgactattatctgtctccacagctaggatgtaggcttcactctcagggatcttgtcttgtcttgttcactttttgtatccctagtagatgctctcccaaatttagatggaatgaattaatgtgggggaggagttgttcagaatgtgatttaatacataaaaaacttttggctccccactcccttcctctctcagtttgcaatggaaagtgattgcaaagtaaagatagtacagattggtaatttggtaatcactgtgtcagtgtggctcacagtggcaacattatcacatgcagattaataaattgaggtcaacagaaactgcttctgcatgcagagaatataggaggacagagaggacagagatacatatagtgttatattactatcaccaattcagttacaatgctgttaggttttgtcacctatttttaaataattgtcctgttacatctttttctttttgcggaaggcaccagtttagcatagtttgtgcaatggctgtccattaaaatcttagtaaggtgataatccaaatcagatgctgtatagcctatgctggtttaagtcctgaagtacttatctgaaaacttcgggttaaattaggaattcagaacttttcagaattcaagaagctaacacaaattgtctttattatgtattaggtaacatccccagtggtgtctgaggcaccatcccacaaacccattgtaatttctgccaaaaaaaaatatgtacactaagtagaatcaataaatttaccagtggcttcatatcagttcctgtaatttttgccactgaagaagttcagagaagaaaagattttgtctccaaatgagtttttaaggagctttattggatgaaattactgaaacattgaaacatatacacactcaaataaaacgaactggaaccgtcgcaaaggatgcagaggaggtggcctgacatcagctgagaggggaggtcagagagaacccagggagcgagagcttcatgaaagagatgcagctggagttgcactttagttgaaggactcctctgcaaaaagctgaatcctccccagcctggatccaaattctctttcctattacatttcagctgccaaaatagctctttgaatttggtgcttagaaggatttagagatactaaaaattgcagcatttcctacagagctatttgtaagaggaaagcaatggaggtagagaagtgggttgttgagaataatagggtgaacttgaaagaggaaaagatgaggattaaaataggggcaatcttcctcatgttgaaatttctgaaattcagtattctctaaggagttgcactctaatttttcttaagggggagaaaatgaaagttttcaaatcatacacgtgcacagacacacacacctatgttttgcagggaggaatagctgagctgttagagccccacacagcaggtaatctctttggcctcctcattaacactctaatcagcccttttgcagccattctaacttaagaaaaatagtaaacctctgaaatagccttaaaaaagatgagtgtaaaccacttcagtctagcttttgaacatggtgtctattgaaaaccctattatgttagctggtaaccaacgatggaggtttcttctccagtagtaactgtgtgtaaaggtttttatgcttaggactgtgtttaggagttgtgatacattttatttagttttgagatggaatctcactctgtcgcccagactggagtgcggtggcacgatctcaactcactgcaacctctgcctcccaggttcaagcaattctcatgcctcagcctcctaagtagccgggattacaggcaagcaccaccatgctcagctaatttttgtacttttagtagagacagggtatcaccatgtcagccagcaggtctcaaactcctgacctcaagtcatcacccaccatgacctcccaaagtgctgggattacaggcgtgagccactgcacccggccaacatatcaattatttggtttgagctagcttacaataaaatcactcttacaacagagattcattgtttcttcatgtttctgtaagctgcatttaagtatcataaagtctaaaaattggataaaaatatgatgactgaccttaatttctacctccctgggacttggttctagagctgtagtttggaccagcactaagtctgtcttaccttttttcccctgataaatattcagtatttgaggaaatcatcacatctccctttagcattcttttggcaaggtaaaagactactgaatccagttttggggaccattgttaaactttgctttttcagaccttagaaacatgttaaagtcttgcaaaggagcccttggcataactgtgtgactagatatgctccaaagctctagaacatgatgatgttccatgtacgtctccatctgagtaagggggggaagagggcttggctggtgctggatgggtctcattcaatgcaatgccaaactcttaacatttgaaaattatatagtagaaatacggactttcttatgaatgccaagaaactgcttgcttctcctattgtctgaatagccagagagaatacttgcacttactattcactgaaaactgacttatttggtgataacggtttggctgtatccccacccaaatctcatcttgaattgtagctcccataattcccacgtgttgtgggagggacctggcaggaggtaattgaatcatgggggtgggtctttcccatgctgttctcgtcatactgaataagtcccacaaggtctgatgattttataagggcagagtttccctgcacaagttctgtcttccctgccaccatggaagacgtgccttttgccttctgccatgattgtgagccctccccagccatgtggaactgtgagttcataaaacctctttttctgtataattaccccagtcttaaatatgtctttttcagtagcatgagaacagactaatacatatggctaagtcagatcctaagtccaggaattccccagttctccataccttccctggagctgtatgtttataagaattttctcttcagtaggagcccttttaaattgcagaagtgctttcttctgaccacagccctatctttgagggaatagctttattgagttattgtttgcatagcatatttaagagtacagttcaataaattttagcatatttagagttgtgctaccatcaccacaatctaattttataacattcactgcatttggaaaggaaacttcatctcatctcatgagtttattttgaatgtggatcttcttggaaaagtaactgattcctcttctttacagataaagacatcagcgttcggagagattgagactgcctttgttctttattccacagggcccagagtgcatcacccaagaaagctctctgaccatgcatggtcaagtataaaacagtgtacgaatgttaaactagtgttagatgatttttgtctatgctgtggggctcacctctcccatctctcccagtctcatccataactgggtctgaactcttgcttttatttattatttaaaatttcaaactatcttgtccttgtctagctaaaattgctaatgccctttttaagctttccttaaagggatttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgccattctcctgcctcagcctcccgagtagctgggactacaggcgcccgccactgcgcctggctaatgtttttttttttgtatttttagtagagatggggtttcaccatgttagccaggatagtctcgatctcctgacctcttgatcctcccaccttggcctcacaaagtgctgggattacaggcgtgagccactgtgcccggccctctgatttttaaataacatgttcttggagaaagtggggcctgaacagtcagtcacattttcttcccctatctccccttccctcctgtcccctcctatctcctcccctctcctcccctcccctctcctcccctcctctctcctcccctcccctcccctcttcgaagtctatctctgtcacccagactggagtgcagtggcacgatctcggctcactgcaacctctgcctcccaggttcaagcaattctgcctcagcctcccgagtaggtaggattacaggtgcccaccatcacgcccagctaatttttgtatttttagtagaaacggggtttcactgtgttggctaggctggtctcgaactcctgacctcatgatctgcccgcctcggcctcccaaagtgctgggattacaagcgtgagctactgcacccggccttcttttttatttttacatatccttaaggactaggaaacatttgggtcacactggtgcttacattcaaacctataaacaggaattaatgtatttctttgccatttattttataaattttattactctgtgtgtgtattttaaagaagaatttctggtgagttttctattcttatttgtatctattacttacctcaatggcttgttccaacatgattgttgtgtgtaaaagtaatttgtgaatagagcatcgctgattagtgttgtcacaattgagcgagtgtgtcccagagctttgcttttcacactcgcacactcatatggatcatctgaaaatcttgtgaaaatgtagattccattcagtgggtctggggtgggacctgggattctgcatttctaacaaactccagagagatgtggatgctgcatctgtgagctgtgctttaagtagcaagttcttatagggtctacagtgtgatgaaccagacagggccaagcaatgcaggtttccccagagatgagcacttcctgcccctcagtctgtagggattaggacacagtgcctatcacagttggcttgtgggaatatattctgggagcagaggcctgcttggagaacaaatgtcctctttgctacgtttttccagcatttaaattgatccagtatgggactgtacagatagcaagaaatgcagatgaacttgggcagtgttaaaacctggatatcctccatgaagcagattgggtctggcccatgctggtggcagtttacctcctcccgctgttccctcttccctggccactgagggtttataaacttgtgaaggcgtggagactctcaggaagttgctgccacatttctctctcttacagacgctaagattccctttcagtaattgaaagtggtctgaaggctctggaaagacagaaatgaaggaccttctttaaaaacaaacgtttacagcaccttctcgaagattcaaatttcgtggattatatgtggttattctagtgtgacatgcgaagggtggataggtacctgtttttaaaaggtatttttgttttgacatttcgtatttccattatttcaaattgcatcagactgaagtcctagcaaaagtatacattacttttatctttccattcatgggaaaatgaaagaaaatgtttcagagacttttctaaaaagatttgatctcctcagtgttaatatccttagctacccaattcagaaaattacagatttccttataattggtttacttgattatttaggatgttttctgtcatcctgggggatgtagaatgtgtgtctgatacagtgattgttagttttaaacaaataagaacatgctatatgtgacacatgcacacctcgtgagctgaactggtactttaactaccacatggcacatttattcccaaagctattgggtcagataccattttctggaaataaccgagtcataaatgatggcgtcttattggtctctacaacatgaccctaggacactttgactgctgtgaaactggcacttaaaatagagtgaaatataattgaaaattgcacattgaagatttcttattcattccttattattagctgcagaaatcatgtgtttatagacctttttcagttggatatcttttgctattttaaaatgattgaatacgttagtcagtttgactatttctgccaaggcaaaaagaagagttaattaaaacacacacacacacacacacacacacacacacacacacactctctctctctctctctctctctttttctgccaaggcaaaaagaagaggtaattaaaacacacacacacacacacacacacacacacacacacacacagtctctctctctctctctctctctctctctctctctctctctctctctctctctgtctctctcactactggtgatatcatctctgtgtagccaagcagaccactacagatcattgcttttcttagaaattacagccgggcatggtggctcaagcctgtaatcccagcactttgagaggcccacctgggcagatcacttgaggccaggagttcaggatcaacctggccaacatggtgaaaccccgtctctactaaaatacaaaaattagctgggcatggtggtgcatgcctgtaattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaacacagacattaaaaaaaccctcaagaactgcttggcaagcgcttggaacacagtctgctcagtatgcaccttcccacaccccctgcttgtagtaataatctttacctgcttggcagagcacgccgttgaggggatacatcacttcacctgctgagatgagtgcagagattttctaatgagaggcatttggtggcaaaaattaattatgacatatttcaaaggcaggccaagaacctggcctcctctccgttcccatccgatgcttctggtcactaagggaaagagaatgacaataacaataagtcaggacttttttttttctgttgtataaatagcagggaaggctggggcttctgacttcagcaccacagaatttttctgcagtgcctctttccctggcacatagcatgctcgttactaatgggtcctaaatgaaccccaggtgtcctggtgctcacctgtgggttgaatctcccttgctcagtaagtgtagaatccctctagggtccacctattttggagggactcaaactaggagtcccctaattgcattcttaggagaaggatatgacttcttgagatgataaaggagacattacctgcagacatttcaggtggaaagccaaattgtgaactttttcttgtgcagcttctccatcagcacttgctgcttcaccttgcactatgttatggagatggttttgctccttaaacctcatgagccaatctttgctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagctcagcttagcagcctgtctgtgtgtgcacgtgtgtgtgtgcatgtgtgtgcgggtgtgtatgtgtgtacatgcgtgtgcatgtgtgtgtgaatgtgtgtgcatgcgtgtgtgtgtgtgcatatttgtgtgtgatttctccaggtgccctcatactgtgtggggacaatgagttgattgctcccctgctgtgtcactgggtgatctaggattatatcactgcctgaggacatgagtaccttttcctttgctgtcccctcaggaaaaagcccagtgtttcacagttggctgtccaaagggaggactgttctccaaccttcctaaaggcccatgtgtggggaaggatggcagtgcttctgacattgggcatggcaggtatgttaatgaggcagctggaaagccatgcccggctttgggcttccatacatgtgattatccctaacaccttcttttatgattattaggctttgaaaattgctctgagctatttttaagaagtctcagaataaaaagagatgatctgggaaggtgagaggagccgatgcccagccactgttaagaacaatggtgtttggcatttatctaggtctctcatcatggttcaggcaggaactccctagccaggtggaacctgtggcaggaatccacaagctgtgagttcaagcctcatgccagctgcctaagctcctatgagaagttggtagatggttcatgtcctttttcctcatttttttattttatttttttttaccagggccagtcttctgtgtaggcagagtgggcagaggcacagatcgtgtgattctaggtttatggagagcacgctcttttcaaagagcttccctcgctgctgtctgtgagtttatctgtgacctgctacagcagcagtccccagactttttggcaccagggactggtttcatggaagacaatttttccatggaccggggagtggggtggggtgggatggtttcaggatgattcaagcacattgcacttattgtgcactttatttcttattcttattacattgtaacgtataatgaaataactgtacaactccccataatatagaatcagtgggagccctgaacttgttttcctgcaactagacagtcgcatctggggatgatgggagacagtgacagatcatcaggcattggattctcataaggagctgacaacctagatccctcagttcacagtagggtttgcactcctatgaggatctgatgctgcagctgatctgacgggaggcagagctcaggcagtaatgcgagcgatggggagcggctgtaagtacagatgaagccatcattcatggctcaagttggggacccctgtgctagagcacacacacagccattatatgtcccctcttgtggctgatttgtttactgtgggagcacagactacactgcagaggagagcagagctggggggaaagaaatggcggtggcatcactttgctgggaaaggctgtcttgttctggaggcaggataaaggcagcatgaatgcttctccagaagactttatcttacaagagcctgaatggatgactagctctccaaaagtaaagcactggaagggaagtgaggtgccaggagataatagttttgaagactagtcctgtgaaacggtgtttctttgtactccaatggcctattttaaatccttatcctatttgatactgtctgcagaatctgatgctagtgactccttcttcctttctgaagctcacttcctccttcgctcctgtggtaatagccttccttgccttctctgcaaagttttcaagttctcgtcttttgtgcttctcttcctctgcctgaactttcaatattgacgtttctggttaacaatctaagatcatatggtcactgtgtgatttatgttgtctactccttggtgtcacaaccacccaccatcatgccgtacagtcggtcccagccccttacgtgagctgggtttttattttggaacttcctaacaaacgtttctagatgaagcccacagagacccgatgctcaggaagtaaacctgtcaagaagccaacacattatttgctcctccaaatgttcttgtttctctgtgtttcatgtcttggttactggtactatcatccacccatgtggaaccatctagaagcctaagaatcaccttcagacaccaccttcccaccccacaaatactctacattttagcagtataagactgtagcagtttcttgaatgtaacatgacatttctcatttccataccttcatttatgttgtttattcttggaatgctcttccttcattttgatgcttcacacgctaatacacatccttcaagacccaattccaatgtgttttctattttggggcctttttgactctcctacgaagactaaattaactgttccttcatttgtattctctaaagggtttgtactattttctatacatttattaaagacccctgagctaagacaacctcctaagaaccctcattgtttcaaggaatataccatatggaaaagtagaaaatgagagtaaaagggaagctaatgtgagggtaggagggaaggtgaggcagaagaggtgaaaagaaagaacagagtaaagtccaagggtaggggagttgagtggccacgctcataaggagctttgccacccctcggtttcccgagcacctgccacgtgccaggcactatgggggctttagtgtagatgatttctccctcgtcttgctccttcatagcaagaggaaggaagcaccaaagtaaaaaacccgagaaaacctggagaaggtgcccaggttgtctcactggtatttagtgctcctagggtggctggaaaaagcatcccgcttcaagaggccaccatctgacacagagcacccaggtactctttcctgtaaagcagaagtccccaacccctgggctgtgaatcaatatgtgtctacagcctgtgaggaacagggctgcacaggaggtgagcagcaggtgagtgagcatgactgcccaagccccacctcctgtcagatcagaggtggcattcgattctcataggagtgggaaccctattgtgaactgcatgtgcaagagatctgggttgcatgctccttatgagaatctgatgcctaatatctgaggtggaacagtttcatcccgaagccatccccaccccgtgtcccatccatggacaaactgtcttccacaaaaccagcccctggtgccagaaaatttggggactgctgctgtaaagcatgcacagtgcacgaggcctggttgagctctgagacttggctgagcccttgcagcagaggtgactgatgaggacacagcatcaggtcgtctactgcttcctgaacttgtactgactttcaggtctttttaccttttatttatttatttatgagatggagtctcactctgttgcccaacctggattgcagtggtgcgatctcagctcactgcaatctccatctcccgggctcaagtgattctcctgcctcagcctcctgagtagctaggattgcagacaccccccaccacgcctggccaatttttgtatttttagtacagacggggtttcaccatgttgatcaagctgatctcgaactcctgacctcaagtgatccacctgcctcggcctcccaaagtgctgagattacaggcgtgagccactgtgcccagcctgagtttcaggtcttcaaacaaaagttcacctgctccagagttgttgaaatgtaatgcattttctggaaaacgtgtgtctcattcatctcttgttggcgtttctgaaaataccacaggttctggagacgctaccgcttcatgtctcctagcagcactggccatctacctgggcacaccagggctccgtgaaaatgtgttcctgggatgccagtgtttccaccctgggatccaggaggcctggctccaaaccccaagtctgcacccactacctgggagatgtaggggcatgacagctgctcagaggtctcagtgtcctcacatatattccaggaacagtaggctggttgggccaccggcgccaacatcctgtggtgatttcttcatcatgacagggtttcgtgtctgtgagatgcctggcgagaatctgtagcaggttgcatgagagctggcttggctctgatgctccacattcttctccgtggctcctttcctttcctttcctttcctttcctttcctttcctttcctttccttttccttttccttttccttttccttttccctttcctttcctttcctttttttctttcttccctttctttcccttcttttcttttcctttctttctttctttctttctttctttttctttctttctctctttctttctttcatttcttttcccttccttccttccttcctttcttccttccttccttccttccttccttccttcctttctttctctcagaattcagactttggttaattgtgacaaacctattaataatttctgctctattagtttcctcatacaatacagtgctttatctgtcagccagagtttccttggtgtgtaaccgtggctcttatccagtgtatctcataatatttattttctgaaataatcgagagcatatgcttgttaatgcttttattagttcacatttgagaatgggttgccagtttgcagtctagataatattatggtgtctctgcatctgcctgtcagctgcatctactacttgaatgtttggttatttctccagcctcccctcattaaccattccggttcctccttaggcagcgctcctcatggccactgagcatgaagccaaggtccctgcagtgatatcctacacagacaagggtgtaaatagcttagtttcatcaggctgttgaaaatgacaccattctccatgcaccaattctttttattttattttttattttttgagatggagtctcgctgtgtcccccaggttggagcacagtggcgcgatttcagctcactgcaagctccacctcctgggttcacgccattctcctgcctcagcctcccgagtagctgggactacaggcgcccaccaccacgcctggctaattttttgtatttttagtaaaaacggggtttcacctgtgcggtggctcacacctgtaatcccagcactttgcgaggcccagacaggcggatcacgaggtcaggagatctcccatgcaccatttccatcatatttttgttactctgagtggtaacagaacctgtagctgctctgttaacctggaaacgggcttgctttgtacaaaaaaagttacctgctttcagatggggccggtgttcatttaatttttctgatgacacaaacttgatgatgatgaagttccctacagagaaagtcacactagaaagactgataagttttcagacccttgaggttggccagaactctaaagaagaggtagatatggagagacttggtaaaaggaatcatcctgacgtagtgacagatgggatgtggaagatgaaggagagggtggaatcaaagacgaatcatgaaagcgacccctctcgtggcgttgaaaagcttctcagttgttggagaatctttcacattgtgagctgattagattgaaaaacacacatatatggggctgtgacctgaactatatctgacgaagtcagcaattgctttgtgtgtttgtgcacgtgttcatgtttgtgcatgtgttcatgtgtgtgtaaatgggcctggtgtttgtgactcagtaactttttctaagagaaaacacgcatcctcacccttgcaggggaggcaccagctgtcagtggtgaaagagagagaagggtcttcattcccctcgtcttccctctgctgtctccccagccctttacctcccgccttggccccttctcccgttcatcttcctctcctcctgctccagagaaggaagtaattaaacggtctgtcctgtgttggctttttttttttttttttttttttttttttttttactgcatatagccctttttttttaaaaaattatactttaatttttacagtatatgtgcacaacgtgcaggtttgttacatatgtatacatgtgttggctttttaaggatgtgagacttgtaaaaacaaaatactatgagtagaagtatggaacaaaatgacaagcctcatttaccttaaaataagaaatctcttggccaggcttggtggtggctcatgcctgtaatcccagcactttgggaggctgagacaggcagatcacttgagctcgcaaattcaagtccagcctgagcaacatggaaaagccccatctctaccaaaaatagaaaaatgagctgagcttagtgtcatctgcctgtagtcccagctacttgggaggctgaggtgggaagatcactgagcccatggaggtcaagactgcagtgtgccctgatggtgccacagcactccggtctgagtgacagggcaagaccctgtctcacaaacaaacaaacaaacacaaaagataaaaaaaaaatctctaggtcagaagcagatgctaaagagatccagtagtcaaaggtgaggggaaatgttagagtgtggtcagggttcatcctgcctgcatgacactgcccatcctgtgctggggatgctggtggctttgggcttgtgtttagatttgcagttggggtcatattccaggtccaatgcattttcccatccctgataagctcagcacgatatgtgacttagctctcagtttctctgaaggagatggccttgcagtttgaactccaggagctcctaggagccactgtggaaaagaggccggagcatgaacaaggagcatctaacttcagcctgacaggacagcagcttgcagtgcagtagttacaacaactccgtagaattaccaagcctgccttgtagtgattggggagggagagttggtccgttgtcacattgttgctgtgactagtccattagctgacctcgggggtgtttctctggctcgtcgaacacagggctgttcagctgttacaaagctcgtgtccaacctaacatcagtgtctctctctgatttccttttgcgagcttgagagctgcctgtgatacactgttggtggtgcttcatggaatttgtcctgtgtgcatgcgagatagttttaattctctttcacaaactattaatgagctcacgtctagggttgctagagtttaggaacaggaatcagatgaggaataatgaatttaaagatatagatagaggactctgagaaaaacagctgagttagtgagtcctatctgtaaagggtatggtttcattctttttttatggccgtgtagtattccatggtgtatatgtaccacattttctttatccagttcaccattggtgggcacctgggttgattccatgtttttgctattgtgagtagtgctgcaaggaacatatgcatacacgtatcttttggtagaattatttattttcctttggatatatacccagtagtgggattgctgggtcgaatggtatttcaactcttagttctttgagcctgctcttcacagtggctgggattatcatacactcccactgacagtgtgtgagctttgctctgtagccttgacagcatttgttgttatttgactttttaaaaaaaccatcgagttggtatctcattgtgcatgagacggtatgtcattgtggttttgatttgcatttccctgatgatgagtgatgttcagcattttttcatatgtttgttggctgcttgtatgtcttcttttgagacatgtctgttcatattctttgtccactttttaatgtggttatttgctttttgcttgtttattttaaattccttgtagattgtggatatcagaccttttgtgaaaaatggacatttttaaagctacaatattttggtttttagcatatccagagagctatgcaacctatatcatgacctaagtttagaatatttttatcacctcagaagagaaacttcaaacctattagcagttattccccgtctaccctgtcccctagctcctgaaaaccactattgttttagtttctatgaatttcctaccaccactccatcatactctgccacccaccaaactaatgccacttccattgctaagcccactaggacactccctaaaacttcaatgcctgaccctcatgcctccgtgtattcctaaatagccatcgctgtagtataaccaaaaacaactatcattccgcgcaactatcattccatataagtggaatcgtacatggtgtcatctttcatggctggcttctttcacacagcgtgatgttttcaaggttcattcatgtagtagcatgtcagtacttcattgctttttatgactgagccatcccattgggtgtatttaccacattttatttatctgttgatcaatggtggacattggggttctttccactttgtggctattatgagtagtgctactatgaatatttgtgtacgtgcttttgtgtggacatgtttttgtttctcttgggtagatatctaagagtggaattcctgagtcatgtggtaactccatgtttaacctgatgaactagagggagaaggttggtaccttgccacgttagaatgacacaaatctctcccaggtggtgagtatagctcccaagtggtgtagctcctgtcctggctaagattcagccattttttttttcttgaataaatactcctcagattcttgtaagcctttggttattttgcagagttctgaggagggtgattttgacagttttgttcgagctgctttaacagaagagcggctttttgggataaatttctcatcctattgcttatttttaaaattactttctttgcttttaagctttaatagtgttacttgaactttgcttctaacagatgcatcatatttcagagataaactcattaaatcacatcatattccccaaaactttgacagaaagttacctaagtcaggataccttggtgactggactttcccctgagattgttttccttcattgcacagtaagttcatattctactgctctccctctctttcttaaatttttctatacttttttgtgtcctctttattgagatacagtatgcattcattcacattctctaatttaagagtgcagtttaatgagctttgaaaaaatgtgtagtcatgtaagcacgattatgatacaaaacaatttcatccttaaaaacagcttccctctatctttttacagtcagtccattcctttacaccccagcccttggaaatcagtgctctgctttctaacactgtggttaagtccctttctagaatttcatataaatggaatcatggagtacctatcatttgggtctggcctccttctcagtacaataccttcaagattcatccgtgttgttgcatgcttatcagtagttcaattctttgttattattatgtagaatttcgttatatggacataactcagcgtgttgatccattcaacagttgatggacatttgggttgtttcctgttcttagctaatttgaataaagctatgaacactcatgcataggcaattctgtgaaaatttttattcttttagcaaaatatttagtagaattactggtcatatgataagtttatgtttaacgttattagaaactggcagattgtgacaaatgatgagtatctttttgtgtatttatttgccacctgtaacttcactgacaaaaggatcacccagctccttgaccagtttattattggacattgccttcctattattgaattgtaagatctctaaatatatactgtcaaataaatgtttttcagatagcttattccaatatgtggcttgctgtcatttctttaacaatcttaatagtgccttttgaagagccgagtcttttaattttcaccaagtctaatttatcaacttttttcttttgtgattttgactgtcatactctatttaagaaagttttgtctcagccaaggtcattaagctttattttgtttgtttctagaaattttgtagttttaatttgcacatttagctctgtaatacagttcatgttaaattttgtagatggtataaagtaaagatcaaggatcatttctgctggtatgtggatgtccagtttgttcatgttatgttgaaatggtgattgtctccatggagttgcttttacttgcacttttattgaaaatgaatttgctactgatggatgggtctgtttctggactctattctgttccattgatctatttgactacctttgcaacattattacagtcttgattactgtaacttttaaaaagacttaaaatcaggtcgtttaagtcttcagattttcttcctctttaaaattgttttggctattctagattacttatgtttcaatataaattttagaataagtttgacgatttctgcagaaaatccacttagaatattaagattgcattaactctatacatcaattttgggagaattggcatgttagtaacattaagtgtatttgcgtgtagatctctttatttaggtattttaaatttttaccaatatcacatattttttaaagtttatcactgagattatatttttaagattattcaaaatgtgttatgaatttttaacttactatttccaattgttagtatacagaaatattatttatttttgtaaattgactttttatcctacaaatttgctgaactgttttattgattttgtagtttttccatacatttcttaggattttctacatagctgttcattttatctgcaaatcaagccagttttacttactaatttctgatttttactgcttttatttccttttcctaccttgttacactggctaggactgccagtaaaatgatgactagaagtgtgagagattaaatctctgcctgggttctagatctaaggggaaaagtgttcagtattcatccattcagtatgttacttgtcagtttctcatagatatcatttggcagatatcttttggcaggttatgagagttcctgggttatggaaaatgccataaatttcctcttagcacttccttgcatgcgttctatgaattttgacgtgtgattatttagtgtttgttcatttcacactcacatttttacacagataagtattgagctaaaggtcccataggactgtgctgcaggtctctagagctcaggtcttctgtgaagcacctcctctccaacaccctgctccataacgtctagctttaccgaactcctggaactctgggctttgtgtcctcagttcattaggccaccaggtcttatctcaatctcctttcttaggctgtggtctggaagctttctctaggcagtgagctggggccctcgtaagctcaaatgtttgtttcctgtctattacagatgactctcttgtactgcctgttgtccaaagtctaaaacacatcattcgtgtatttttcctatgttcttattgtagaaaggagagtaaatctagtccctgttattcctttatgctgagaaacagaaatctgtaggtttactatcacactgatcttgtgtctctgatttcatgaaggaagcgtgcatgagagaaactcccagaggcagatgtgctctaggaggagtgaaggacagaaatggcaagccctaggtagcgcatgaggctgggaccaccattctggggttgatgtttctccatcacacattaggttgacctggggagtgtctaggaaaacactgatgctgttttgcctcacaaacactaagtcaaaatcccaggcaccagtgttctgtgaaagctatgcttgggaaactgacgtgaacctatttgtgtgaagcatggggctagctcctctaagctgattctgacctgtcttatgtgaggtcactgagctggctctgagatgcctaccaatattgaagtatttacagactgaagcaatttaggcagcatgctctagtacttccagtatcttcagacaagctgcaattcttctaaggagctgaggggcaggagggtttgatctcacttggtagtacagtggcagttgggaagtgcccgtggacatgtgctatgttcagaattgtcagaattgtggacagtcactccaggcactaatactgggaactgccaatcaaggcacatggtagcaacttagtaaattgcaactttttttttttttggaatgaatttgatcaggtaatttgttatctctgagcctcagtattgtattagtattgccatgtgtaaaatagtctacttctgttatcttccaggattttgtgaaactcacataaaatagaccacgtgaagacatttaggaatttatttaaaaagagggaggactataaatctacttagtatgttttatgtcttaataatttaatttagtctaaaagtgggttagatgtaacggtgcctttagaaattaggtcttgtgtaaataggcattgttttggtttgaattagttcatagaggaaagtaggtttactttaataaataattgaaaacatattaatacaagtcgcaaaaattttttagtgaaaagtgtggaaagaaaaaaaaactacaataaaacggatatggttttctgctttctcgttgttggtattttatttaagcattcattctttatataaggctcactctccttggcttttcttcctctctgaaataaacagacattagtcacatgcagaattaaacgctgctgcagaattttgtggtgtggcatgagacactcagagctgatggaagtctagaaaggttaagccgttgtccgacctgaatcaagcaattcttttcaaacattcagtaaaatgcggccaagtaggcataatctaaaatggactatgtggaggtcccgtgggcaagattggggaggaattcctgggcagtcttcatccattttctttttcctattatggtaagctaactcacagcttaagtcaatccatgaatccatctctagtcctgggtcaagcaacaggggtgggagtctggtggggaatccggcacttagagtaacgtgttcaccatcgctcgtgtgtgtgtgtgtgtgtgtgtgtgtgtgtgtgtgtgtgtgtgtctaatggtaggatgtttcagtctcttctcgtattgctccagagagagcgctgtggtctcacaagtcttctgaggattcttcctggtggttcagaacagagtgtggactacagaaactttaatgtataatgtgttcaggaaagagtacctgtaatattttgcactgttcatttttagtatagaagctgcaactcttgtcttaatctacatctggttttagaaggcaggagttcttagggaaaggctggtgtagcttcattttggcaattttaaaagttttacccgatgaacccttagccatccttgttagtcctgcagacaaccgtgaacataccacagacaaggtgctcagaagggggacttacctatgcaggtccaatcatctgcaaaggatcgggcacattggagcctgaccgtcttaaaaaagcctttctttatgagaatccgtgggctttttctgtccaaggcaaagcacaaagcacttgttgggcctatttaaggcactgcaggatggcatccttgatggggtgtttcaggtaagccacttgcaccttttgtagtaactttcttatagacagtgggctcattcagtgtgtggcagatgcccggcaagcatgcttcatcttgctctgcagtggcaactctctcgtttcccatgtggaattgtgaccatggagcttcgtattttcagagatttagttcctaatgaataaagtattttaaatgtacttatttatttgtgaccccaaaaaagaagggtttgggttagatgatctctttcagctttcagagcctgcagtccctttcctgattccgaatcataaatgtatgggaatgtgtcaatgtgcaagagaaagaggggaacagaaaaagtcaaatacaaacacaagagtattccagttaacttaagcgagaaaatcttccacaattcctctttcttttggattctctcctgttgtctccaaggctcactgactccaacacagggccctgagggtcggttgcaaagtgcttgaacattctgtcctttgtttcacatctagtctcatttcagggtccgtttgttgacacttgaagtcaagcgctgtgtcatcagagagactctggtgcaaggcagtcagctgtttactttgctgcacaatctctgtgcccagttcagccagagagagcagccctgcatgcagcaaaccagaaccaagcctgcagcaggactcaactaagttgtcactctggagtgtttttctggctggaaatgaagctaatccttcctaatgcgctggcttcttcgaccatgtccaagcgagggctcacatttggctaaggcttcgaatcctgtttcagggaatccaattcaattaattcaatgttcctctttacttagcaaatactaaatacctactacgtaccagccagagcagtaggcactggagtacccatgagacgtaaatctaggtacatagtgggaatcttaaatttgctaggactggggaattcgggtgtatagccaaacaaagaaaatgtagtggaagaaatatcaaatgcaaaaaaagcaagaattcttagtttaaaaaaaaaaaattatttcacttatgaaaggagtcttctgtgaaaccacccctaggtgtaagccctggggatagatcgttagaaacaggaccccccacccacccccacagagtacctgggaacttaagcctacaaagattttctagactctctattagagaaattttaccaaaacagttatgtttcaggaaagtggggatcattttacccagtggccttgcaagtttcacagcaagtctccttgttatgggtctacagggaattaaggcaacttgaactaagagagaaaactatggtatattttctaaaaaaaaaaaagaaaatactgcaatgagagttctattttttttttttacttggtagagtaagtcatacctaaaatttccctgtaagaccttggtcaaaataagaatgttattactttggcttaatatcaaaatggtaaaacatgaactggaagtcaagataatagttttctttacatcttaattgcaaatccttcaagaaaaaaggaaaatatgacaaaagcaatatagcatagacattgaatagagactttgaagtcaaaaagcttgaaatcaaataatggctctagccgtcactcaatgtgaggtcggaggcaacttatgaaacctctcttagcctcagtctttccatgtgtaggatggggatgataatatctatttcacatggttattattacaattaaatgagtggctaattgaaaagctctttaacaagtgcctggcatgtagaaaatgctcagtaaatttcatttactatcattcttgttgctactgttactgttattattacctgcagtgtgtgaggtcttaggctgtgcttggacttggacatgaactgggaagggtgaaggggagggtgaactgcaaacctgagtaagggtgaaggagagggtgtactgcaaacctgtaataaaagaagtctgtattgaaagaaaaagaagccaggatccccagagatacaggggagagtgtagaatgtgagggaaccagcaaacccagtgttctctagtcttaaacactgaaacgtctgagacagctttatacatctccttgggcgcatttctctaacagacaacagtgtggaaatctgatccagctaacaacagaaacacgaagaaccaactgcataccactccatcaagagccaaccctggtttaaagtaaagcttcctgtggtgtttcagtcttattatccctccagggatccagaagtcatcatgaagatatttcgctaaaactgcactcgtacgtttaaacactgataatggaaaaatgtattttgccaaaaacagtaagaactgcaacttctattgaaacatactgagaaatagtgttatagtgaaagtcaaagatctgatgttgaatcaggttgggagggcaagaaatgattttcatgaagaaggaagaaaatgaatattttcaaaagctcacctgcctggaagtcacaatgaagcattaaggaacatctgacataaaaggagggagtgtaattcatcaagaggatgcccatggggacttgattgctggactttatttctaagtcaggggaggcatgatcctaagcattctgaagagatggaagggacatcggggctgccactgggcccctccctcacacctcatgctccaccaggagagctcagccttgccacgcggctctgtggcctgggacctcagggtcggggtgagccgtggtcctgctcaggggatagcaccctctgctctgctgtgcacggtagccccacttttcattctgcacacttcttctaagctgcaggagctcctggctctttttcatgtcaccaaagagccttaaatacagaaatcttcatgttttctttcttttttttctctttaggagtctctagactcctcttggcccaaaggttaacatggtaggtggcatttgcattaagtaggtaccaataggggtgtgtgtgtgtgtgtgtgtgtgttgacctttgctttgatcagcttttattacaaaatttgaccatgactacgtttgtgtgcaagagatgccgctggaagtatagtcccaggctgggaagctgctacctagcagcaaagttacactagggaagaggaggtgcacagctgtggctgacagcagcggcctttgccacaatcagtactgggcttcagtggtctttctccctctattatatcacatttattataacagctttatgtgcatgtgtctctaggtcaccagctccttatgagaagtacccgagctgtttatctttctttctccaggccccagcctcattctttctttttgtcctgattttactttttttattatactttaagttctgggatacatgttgcagaatgtgcagtttgttatgtaggtatacatgtgccatggtggtttgcttcacccatcaacccgtcatctacattaggtatttctcctaatgctatccctccccttgtcccccacccccgacagaccccagtgtgtgatgttcccctcactgtgcccatttgttctcattgttcaactcccacctatgagtgagaacacatggtgtttggttttctgttcctgtttgtttgctgagaatgatggtttccagcttcatccatgtccctgaaaaggacacgaactcattctttttatggctgcatagtattccatggtgtatatgtgccacattttctttatccagtctgtcattgatgggcatttgggttggttccaagtctttgctattgtgaatagtgccacaataaatatacgtgtgcatgtgtctttataatggaatgatttataatcctttgggtatatacccagtaatgggattgctgggtcaagtgatatttctagttctagatccttaaggaaccaccacactgtcttccacaatggttgaactaatttatactcccaccaacagtgtaaaagcgttcttatttccccacatcctctccagcatctgttgtttcctgactttttaatgatcgccattttaactggtgtgagatggtatctcattgtggttttgatttgtatttctctaatgaccagtgatggtgagatttttttcatatgtttgttggctgcataaatgtcttcgtttgaaaagtgtctgttcatatcctttgcccactttttgatggggttgtttttttcttgtaaatttgtttaggttccttgtagattctggatattagccctttgtcagatggatagattgcaaaaattttctccctgttcactctgatggtagttgttttttgttttgctttgttttgtttttgctgtgcagaagctctttaattagatcccatttgtcaattttggcttttgttgcaattgcttttggcgttttagtcaggaagactttgcccatgactatgtcatgaatggtattgcctaggttttcttctagggtttttatggttttaggtcttacatttaaatctttatcttaagttaatttttgtataaagtgtaaggaaaacgtccagtttcagttttctgcatatggctagacagttttcccaacaccatttattaaataggtaatcgtttccccattgcttgtttttgttaggtttgtcaaagatcagatggttgtagttgtgcagtgttacttctgaggcctctgttctgcttcattggttgatatatctgttttggtaacagtaccgtgctgttttggttactgtagccttatagtttgaagtcaggtaccatgatgcctccagctttattctttttgcttaggattgtcttggctatatgggctcttttttcggttccatatgaaatttaaagtagttttttctaattctgtgaagaaagtcagtggtagcttgatggggatggcattgaatctataaattactttgggcagtatggccattttcacaatattgattcttcttatccatgactatggaatgtttttccatttgtttgtgtcctctcttatttccttgagaagtggtttgtagttctccttgaagaggtccttcacaccccttgtcagttggattcctaggtattttattctctttgaagcaattgtgaatgggagttcactcatgatttggctctctgtttgtctattattggtgtataggaatgcttgtgcatttttgcacattgatttttgtatcctgagactttgctgaagttgcttatcagcttaaggagtttttgggctgaggcaatgggattttctaaatatacagtcatgtcatctgcaaacagataatttgacttcctctcttcctaattgaatatgctttatttctttctcttgcctgattgccctggcaagaactcccaatactatgttgaataggagtggtgagagagggcatccttgtcttgtgccagttttcaaagggaatgtttccagcttttgcccattcagtgtgatattggctgtgggtttgtcataaatagctcttattattttgagatacgtcccatcaatacctagtttattgagtgtttttagcatgagggggtgttgaattttatcaaaggccttttctgcatctattgagataatcatgtggtttttgtcactgattctgtttatgtgatgtattatgtttattgatttgcatgtgttgaaccacccttacatcccagagttgaagccgagttgatcatggtggataagctttttgatctgctgctgtattcagtttgccagtattttattgaggatttttgcatcaatgttcatcagggatattggcctgaaattttcttttttagttgtgtctctgctaggttttggtatcaggatgatgctggcctcaaaaatgagttagggaggattccctctttttctattgtttggaatagttttagaaggaatggtaccagctcctctttgtacctctggtagaatttggctgtgaatccgtctggtcctgggcttttttttggttggtaggctattaattactgtatcaatttccgaacttgttattagtctattcagggatttgacttcttcgtggtttagtcttgggagggtgtatgtgtccaggaatttatccatttcttccagattttctagtttatttgcatagaggtgtttataatattctctgatggtagtgtgtattttgtgtgggatcagtgttgatatcccctttatcattttctattgtgtctatttgattcttttttcttttcttctttattagtctggttagtggtctatctattttgttaatcttttaaaaaaaaccagctcctggattcattgatttttgaagggttttttgtgtgtctatctccttcagttctgctctgatcttaattatttactgtcttctgctagcttttgaatgtatttgctcttgcttttctagttcttttgattgtgaagttagggtgtcaaccttagacctttcttgctttctcatgtgggtgtttagtgccataaatgtccgtctaaatactgctttagctttgtcccagggattctggtacattgtgcctttgttctcattggtttcaaagaacttacttatttctgccttaatttcattatttacccagtagtcattcaggagcaggttgttcagtttccatgtagttgtgcagttttgagtgagtgtcttaatcctgagttctaatttgattgtgccgtggtctgagagactgttcgctttaatttccgttcttttgcatttgctgaggagcgttttactccaattatgtggtcaattttagaataagtgctatgtagtgctgagaagaatgtatattctgttgatttggggtggagagttctgtagatgcctattaagtccacttggtccagagctgagttcaagtcctgaatatccttgttaattttatgtctccttcatctgtctaatattgacagtgagatgttgaagtatcccactattattgtgtgggagtctaagtctctttgtagttctctaagaacttgctttatgaatctgggtgctcctgtattgggtgcatacatatttaggatagttagctcttcttgttgcattgatccctttaccattatgtaatgcccttccttgtcttttttgacttttattggtttaaagtctgttttatcagagactactgcaagccctgctttttttactttctatttacttggttaattttcctccatccctttattttaagcctatgtgtgtctctgcatgtgaagtgggtctcctgaatacagcataccagtgggtcttgactctttatccaatttgccagtttgtatcttttaattggggcatttagtgcatttacatttaaggttaatactgttatgtgtgaatttgatcctgttgttatgatggtagctggttactttgctcattagttgatgcagtttcttcatagtgtcgatggtctttacattttggtatgtttttgcagtggctgttactagttttccctttccatatttagtgcttccttgaggagctcttttagggaaggcctggtggtgacaaaatctctcagcatttgcttgtctgtaaaggattttatttctcctttgcttacaaagcttagtttggcaggatatgaaattctgggttgaatttttttttttttaagaatgttgactattggcccccactctcttctggcttgtagggtttctgcagagagatccgctgttagtctgatgggctttcctttgtaggtaacctgacctttctctctggctgcccttaacattttttccttcatttcaaccttggtgaatctgacgattatgtatcttggggttgcccttcttgaggagtatctttgtggtgttctctgtatttcctgaatttgaatgttggcctgccttgctaggttggggaagttcttctggataatatcctgaagtgtgttttccaacttggttccattcttcctgtcactttcaggtacaccaatcaaacgtatgtttggtctttccacatagtcccatatttcttggaggttttgttcgtttcttttcattcttttttctctaatcttgtcttcattctttatttcattaagttgatcttcaatctctgataccccttcttctgcttgattgcttcagctattgatacttgtatatgcttcacaaagttcttgtgctgtgtttttcagctccatcaggtcatttatgttcttctctaaactggttattctagttagcagttcctataactttttatcaaagttcttagcttccttgcattgggttagaacatgctcctttagctcagaggattttgttattatccaccttctgaagcctactgtcaatttgtcaaactcattctccatccagttttgttcccttgctggtgaggagttgtgatcctttggaggagaagaggaattccggtttttggaattttcagccttttcgcgctggtttttcctcctcttcatggatttctctacctttggtatttgatgttggtgaccttcagttggggtttttgcgttgtcgtcctttttgtttatgtcgatgctattcctttctgtttgttagtttttcttctaacagtcagtcacctcttctgcaggtctgctggagtttgctggaggtccactccagaccctgtttgcctgggtatcaccagtgaaggctgcagaacagcaaagattgctgcctgcttcttcttctggaagcttggtcccagaggggcacccaccagatgccagtcagagctctcctgtatgaggtgtctatcgacctctgctgggaggtgtctccccgtcaggaggtacgggggtgagggacccacttgatgaggcagtctgtcccttagcagagcttgagcgctgtgctgggagatccactgctgtcttcagagccagcaggcaggaacgtttaattctgctgaagctgcgcccacagccgccccttcccaaaggtgctgtgtctcagggagatgggagttttatctatatgcccctgactggggctgctgcctttctttcagagatgccctgcccagagagaaggaatctagagaggcagtctggctgcagtggcttggccgtgctgccatgggctccgcccagtctgagcttccctgtggctttgtttacactgtgaggggaaaaccacgtactcaagcctcagtaatggcgatcacccctcccctgaccaagcttgagcatcccaggtcaacttcagacggctgtgctggcagccagaactttaagccagtagatcttagcttattgggctccatggagatgggctccgctgagcaagaccacttggctccctggcctcagcctcctttccaggtgagtgaacagttctgtctcactggtgttccaggaagcactggggtatgataaaaaactcctccagctagcttggtgtctgcccaaatggccacccagttttgtgcttgaaagccagggacctggtgatataggcacccaagggaatctcctggtctgtgggttgtgaagaccgtgggaaaagcctagtattgggctggatagcattgtccctcacggcacagtccctcatggcttcccttggccaggggagggagttccgtgaccccttgtgcttcctgagtgaggtgatgccccaccctgcttctgctcaccctccatgggctgcacccactgtctaaccagtcccagtgagacggactgtgtacctcagttggaaatgcagaaatcacccaccttctgcattggtctcgctgggagctgcagatcggagctgttcctatttggccattttggccaggaatcctccttacagatgctgtttattctaacaaccattctgtccataacacacacacacacacacacacacacacacacacacacacacacacacacgtgtcacaagtgaaattttgggcaagtcattagatgtctttgaatatcactcacacagcaaatttgtgggtatcccaggattagaaacaatttatctcaattgttaggtcagagctatttctccttatgtctgtgatttctatctaatgtgtatattaatataagaatttcagaaattatgcagtaatttaaaagttcaagaaacctttattgcaaacacctccttctgcatttcacaggagggcctaaagaaaaactttttcatagaaacatgtacacaagacaatattaccagaaatcaacccccaaaatgaaggcatcagggggcacgaagaagagacttaacaaactttttttcttcccttgcaaattctggtatcctaagaagcagtctgaatgatttgtgcatgaaactgccttggagcaggtgcaacttcagggggaattctcttatttttattgcataaaaaatgaatcctatggaaatacagactcctgttctgctgagttttgcattcgcatagctgaattaggagagggagatccagacagtacagtgtactgataccatttgaaatatccccacttgttcttcatgaattcccccatgaggttgtcatcatttaattcaatttaatctttaaaattcaaactcttttgaaactttttatatgtggagtgctctgatctcatttttggcttctatgacacttttcccttaaaagcaaagctgtgatctgtggcgaggaagtttgagtggtgcatcttccagtctcatctctgccatttgttccagtgtctaggaggaaagaatctttgcactatgcatattcagtgcactagggataaagtggccaatgtgtcttcattccccaagctagaatggtccttcatttatcggccagcctttgctgaacacacaggtcctgccattcactgtacaagggaaagatagagattaagatccaggcaggtccctgctcgcagtgctgactgagtactgtacctatttgcccatgtgatgtgtctttctattttccaatgagagtggaggtccatgttttaagactactttgcctcccattgactgaggattgggattagatctttgattgggctagagggagaggtgagacactttgaaggggtacagaaataatctgtggagggagaggaatcaagagggactggacaaagttgtgtctttatcttctggtccccagattcaccactcccctaagagcaacagcactagctcacagctttagcatgacatcctctgtagctttactcacagtgggaccagttctgtcacagtaggaagaaattctgtcaaggactaatgtcattgctccccgggtggcccaaggcatccccagctgatcatgtgaccagccagcctcccattcttccaggtcagagagaaatgatctacttttttatcttggtgtggtggatgggactaaggaaagaaagagttggggtttgtcatattatttctttactttgtactcagtagattatattgacaggcattgagtaaatccagtggaaacatgaactctccatactgtagtagacattgaataatttgagcagaataacagagagaaaaggaaaatgactaaataacattttaggaaataagctacatttcctagacgtgggatttggcaatttgggatggatggagaaatgaactttgtgtatctctctgaaacaggtgaaattgacattctggaacaaaaatctaactatgaaaaagaaaactctttatttcaaatctatacttgggcaacagtttggggccaggaggaataaaagaccttaacaggtcctctgtagccctctctgacttctaggcgtctgagtaatcacagacacccacacattgttttaaaaccctccagagagagaaagggagaaaaaatgtctttgataagatcaggtgcgttcagggtcgtatggctgtagacagaaaaatgtttttgtttccactggttacacattctgatgtccgacctacatcccttctgatgaaattcaaaccaaacccttttctttcccagtccccattggaaacagaaaatagatatgcatttttcacactttaaagaactcatcatgtaaaaaaattgctttttaacacatttcatgccatcatgtcttccttggaaattttcagtgcctttttttctatttgtctaagtagagaagctatctttctattttttttatggcttcttctgaactcctaccgagacctgttcatctcacatcttcaggccccaaattggatacacaatttttaattaagatgtgatccagcgaagtatttgcttagatcttacagatctggaaaaaaatgcccttaagaaaagactaggcaaatagaaataatataatctccttgcctcagtccaaacttgaaggactcattagaggatgcatgcaagtagggaccagaggaccatgaaaatcctgctgggattgagcgtgatttctgctgagatcactgagatgccacaacattgaatgctgaaagttttagcaggaatcgttggtgaacttttcctttggaattccgcaagtgcttcttgttacaggcatagacaaatgtatactaaaaattacatgtataatttaaatttcagcaagaaatactgttgacttcttatgaggaaaaccaggcaagtgatttgtaaactcttgaagcaagaaatgttgatgtcttctccatctctttatcctgtagagcacgttgcactgagatggccccagaagtagatactgagaaagttctagttgaatcatttaatttgaatgaagctgtgagataaaaggaaaaaaaagaggctacttataaaataaatttatagtatggtcacattatccagagtaaggttagttcggtttggtttgaattgtttcatttttagccaggcacagactgctcagaaagtaagcatttaaaaatttgtcgagatgttatttattatttggtaaaagttgcaatgcaccaagatgtaagattttacacccctgagttttatggcatcacccttgctaatttattcatgattaaaccaaagaactctcaatgaggagaagtagattgcaatataaattggtgtcattgtttgtaaatgtgctccactaagcatatatactgctccactaagacagcttctagtaccatgcctggggcttcaatgcaatttgcttacgttgaatcactggctcccagactccccttgtgaactgaacaggcttagaaaatcattctaaagaatgcatggtttgtgtagttgtagaacgaaacttctcttggaagcttattccccctcaccagggaaggagttagtgggagattctcaatctggtctgcagatgagtgccttctaggtaattcacacatataatttacagaagtgggaagaaatgaattcaaaccatttttttttttccctcagaaaactaaatgtcaatctcattccatttccgttggacggggaaattgacgtaggagcagcgtgaggtagagtggcatgctgaccataactagggtcagtcaccatcggaggacccagcagagagctgtggggtgctgcagctggggaggactttctccatctgtttccccttggtaccattgatttgttgtctgatttaaatatagagttcagtatgcaggtgtgtaagtgcagcataaataaaatggcatcctccttcacagccaaggggccttcgtctgggaaactgatataatttatgagagcgaggcagcagcataaatacgtggggtgctttgtcaccggccagtatggaattggtcagcttggaggaggggaaacagagtcagggggaagacagcatgccaggaggagctaaattggggcaccaggacctgaaccctggaagccagtccctaaacaaccagagctgctcagcaactgctctctaattaccctttgtccctggagaattccagaggggatgggattgcctcagtgaacttaatcttagatgggtggctgtcctccttctttttttcccttgacggaggagggagggagggcgtcgagggtgatgcatcaaactgagggtgacaagaagctggcgccttttgctccacttcccagccaggagggctgacagtgctggagtggaccagtccgcggagctccgggggtctgaatgctccaggggtgtgtggatggcaatggccaggatggccctcctggttgcgacccatcagaaagtggataccactgtcctctggtttgcctgctgtgctggtaaggtgtggtgacgtgtgtgtgcctgtgtgtgtgcaaagggcaaagagatggacagtgttaccattattcatttggaattagaattgtggaggcttgcacatttgtttgtcttccaagttctggcctcacccacccttttttgagggagagaggggccaggaaggaggccgttcccagccccatgagtcaaggagggcatcgggggatgctcccactgaggaagctcagagcggggcccggagaaaggggtgctccaagcggtgcttcctggtcgatggcacgtcggggtgggcaggctggagttgaagagcttctcagcgtggataggaaatcatggaaatgaggaatgatctagcctccagcagtgagtcggaggaataaatgaatcccggaaatgcagtttctgtgaactccagattgctatggagattgcattgctttcccaagacttaaaaaacgaagagtcagcgaaagctgggagagcggtgatgtatggaagtcaggcgggccagcgcgccgggagtggtgggaagggggcttcgcaggtcattacacggggatttctccgcgcagaaaaagggattagcgttttcacctggtggggatttcatgagcttttccctggcctgctcttcccctgccctttcccagagagcccagcttcagggacagcgcccgcgaggtgctgctggggtggcggggcttgtgggcggaggagggcggctctctggtgtgcagcaccgggtgtgagtgtgggtgagcgtgtgcgggagagggtgtgagtgtgagtgggtgggtgggtgtgaaaatgggagaaagtgtgagcgtgtcacagtgtgtgtcactgagtgggcgagtgagaaagtgggtgaatgtgtgcgtgactgtgcaagtgtgtgagtgtggggagtaagatttgtgtgagtgtgagtgtgcaagtgtgtgagtgtgggggagtgagtatggggaggagtgagagttgtgtgattgtgtgtacacacacgtgtgcacacagggcgggccgcgcttggcatttgaggaggggctcggaggtcctcctgggctggccgctgtcctgggagcagggcaccagggcaccctgcgagttttcaccttgccaaggtatgccagaagccggactccagcttccttgccaacgtgtgcgggaagcaggaccccagctgcggtccagggaggaaaaggggggtgctcacagctggggcgagtccctggagcccacaggcagtgacttgccccagaatgagcttgagagagtctggggatggagaacactggggatgcttggtgtggtgcagaggtaggaggatgtggatgcctgtgaggtactggtgcgaggtttgccacgtgttatccctgcatgagagagcgtggaccactgttttaggccaggatagggacagcatgtccaattacacagggctctgcccacctgcaagatgcaaggaggccctgtctccaatgtcccctgacctgacagtcctgccacctgccagcctcgcagtggccagccccgcccccagcaagccccacccctaagagccacacccccaacagctcacccccctgccagccttgccctcagtcctgccccctgccggccttgcctctgccagccagagccagtcccccagcaagccccgccccctgctggctctggcccttctaagccccaccctcaggcagtcccgccccctgccagccccaccactgatcatccccgccctcagacagttttgccccttgccagctggaggtgggcctcctccagccagagtgaatctcttagtaagccccaccctcttccagccccaccctcaggcagccccacctgcttccagccttgctgaacagtcccgcccctgccacccacatgggttcctgggtcttgcccctgactaccagggtgaccccaatgcctccgagacatccttctgccctagaacagccaggagagcagagagaacaatttaaatgctcagaaagacaactctttcttactgtttttgctttgcccagggaattgcaatcagtttcaatacacagttaataaaatgagaggcattcagcgtggatgtgggtgtcaagggagagggctcaggcttgcttttgccttttagtaccagttcctattgtttggaaaacacgaggtggcttccgagaacaggtcttggccctcgcctgccctggagccccctgtccaagggccgccgtgcctcacaggcaggtgcattgctcttgttttaatggtggccttcatggcagtgggacccctccctccatgactgtccccaggtattgcctatggtgttatagtgtgggggcctcagggaagggtaggtgacctgtccacatttaacataattgtaaagctcattgaagaaaagaggacgaaggagtgacgtccaagtttattgagctttaggaagagaacggccagatttcgttttgagattttctcttatttgctggaagtctgttcaaatcatatgtctcttctgggttattaaacggtcaaggttgtttctggatccccacaaaaatgtgaggatacaaagtccccttgggatgtgcagtggtacccatagtcctcgtggttagaggataaaggggtccctagaatgatggagtaataagggcaaggtgtttggaagcaaatgccgagaagaaatgctcccttatgccgtaaaggccaggagactgtggtcgtcaggctgagtggatggatgggaaaggaggaagtaaagagcacacaccggcttttggaagcagatagctcatagcatttgaagagggcattgccatgactctggcctgcctctctcattggggaatcaaatattaaaaaaaaaatacttatatatcttttagagtgatcttctttggtaatttttagtatataaaaaagaaaaatagggaagaaaccttcaagtttctacttacatttcctgaattaaatagtttacatccatagaagaaaataaatattcatgcaaagctatacaaattcctttgtaggtttttagtaactattctaacagaaatgtatttgtagctaaaaaatgaagtgttaagcatgttttaaaaacggagcattgattttctacagcagggatatttagagtcttctttcccctggttacactcatgtgcatttgcttaaatccagtggcctctggctgcacctgcctttgcatcatgactttgtccaatcctgcatgtgttaatttagggcccaagggaccagtctggagcacgcagccatcctgagtaattcacagtccattagacagcggtctgtggggtatgtgctgagtccacacactgatgttccaggaggttcttgcaacttccccaccttgcagctgcctctccagcaccttactctcagtccttccccacaactactctccatctttaacttattacactccctgtcttagtccctttgtgttgctataataaaatacctgagtctggataatttataaagcacagaaatttgttttctctcagtcctggggtctggaaagtctgaggtcgaagtgctggcatctggcaagggccatcttgctgtgtcctccatggcagaaggtggaagagaacgaaccttctcctgcaaccccatttttttaatacattaaatgcatttataagggtggagcctcatgatttgaacacctcccaaaaggccccaccccccaaacactgttgcattggggattaagtttccagcacataaattttggggggcacattcagaccatagtacctcccaaatctataaggccacctctactttgctctcagctctatctgttcatttgcaattgtcttttaaaccccacttaaatgtcctatcacattttatcaacaataacttacttcactgggcttccttacacacactagttcctattcctgacttctgatttttattaatatccctgttcttctagttatccatctttgacacttataatatctctttcatttactacatatagtaaagtgaccacattttgacaattctttctccagtgtaagtgtggtgtcctataactaatgcccttttcttcctatagccatcacttgcatcctccatgattggaacagtcccctggtgtgccccacacctgctgttctcctctccagcatctaatccgtcctacccactgccatcagatcactatggagagcccaggcctaatcatgtcaattccaggctatcagatgttcattgtcagtttaatcacagaattggctgaagtcctttatgctctaattattccatcatcctcaccctcttctcctacatgcaattgacactatgactaaatggggtacttgctcttcctccaaaaaagctctaaacgtttttgtttccttgcttctgtaaggcagttcctcaccctataaggggcccattctgtccctgaaattctcatccctcatatttatctcttgaaatactgtccattatttaaaatacaggtcccataccttctttttcacaagattttccaattttcttaacttgaagtcatagctctctccccctacctcctccttccccggtatacttggtaattctatattcacattattcacacacatgcatccaaacatttttcttatccttctactaaatatgaaatatcataagtagaagccactcctgcttcacggcagcagtctcctacataaccacagagtttagacttcactaaaatgtaagctttgtttttgtcaaggttgtatctgaatcagtgtctatatcagggcctgtaacctagcaggggtttcaagagtgctgatgcaatgaacagatgaatgaactcttgtgaagcaatagatctagcacccagattgatcccgtcttcttacaaacacatctttaggctgtccccctgtgtcttcttcaaagttgacactgatattcgtttaaattttatttcacctgaataaaaaaatatagtgtgagaatgatctgctgagagcccagctctccttaaaaaactctgcctcaaagatactttaaattatattcttgatgaaatttgtattcttcgtgatgtatcaacctcggcagcaaatgacaacaaaccacagctggttactgtttgaacccaaggttgtaaaccaaagagtgtgtgtgcatttctccccaccctaccccatacaacctacttcatcctcatgcatgtgtagataacaggtcaaccaaggctagaaatcataatgggtgtgagttctggttccagagttatatcacctcaatgatcttattcatttcattcctctacccttgcttgagtaaagctaatcattttctcatcttccccagatctctttggggttctaaaccaagctgaaaagtagaccacagttaatacgccctctttcccagccacccagtacatctcctgtctttagccagggaagcacctgtatgccccaattctggccaatcttggctaaggtgccaactctaacgattctagaagctgttggttaagtgtgttgcctgatcagggatacttccttacaatgagggagttatgaagaagctattggatcaataagctaatattatagaattacactatccagtactagatctggaagcaaccttataggtacatattctaactccttttataagtgaattaagtgacctctctggttgagtgatataagatctagtccaggctgtgccactaactcccaattcatgtgtatttcaccataccatctgcctttcctctagagtctccaaagaacaaagctacaatgagggaataaaaaagtagaattcacaatgttaagaaggcagttctctcaaaccataccacgtaacagcaactcctctgcctagccatggtgccaaccccatcaattttcaataaaacttcacctgtaatattcaaggagtagtggagtacgtgataatgcactagatttaaagttacccaagggctaatttttaaaaaatcatttttcatatccaatattaaattggttgttagttcttttctatatgtctgtgataacctttgtgccctggttagcagggtctagaaagagccatccatctcaacaacagtggatttagacttgcaggaaacatacagcttgagtgatttggctgtatctttaatgattcctgaacatctgccagaaagaagttgctcatttcaagtaagtcagtgatttaaacttatttttctgttttgtttctttctattaaaagtttctcctaaaattttaatttcatgagaaattctgattagttgggaagtaattttttttagttataatacaagtcaaaattaatattgacttaaggtataaattaagtttactcttgtagtgcctatgaaagactaaaattatgctgttcataaaatgtccctacagataagtttcacttaactggttttagaagatgcttttgggcctttttatttgccctaagcagacatttggactcccttaggtgaaatatgctccagcattagactgctttatttactttgagtttgtcttctcaatatgtgatttttagaaacttcaaaagtacaatgtcttttacatttataagtaaataattgagggaccagcctgcctggagcaaaggaatcagaaaacaagaaatctcagaatgactggtgacatggagtctgtgcttcactgcagttgctagaagtaaaccacagattgagctctgagcttcctaatagccatggcaaggagggaaagccattgaggtgctattcacagtagccactgataaaaacaaagcagccattcactagccatttcctgctagtgaaacataaggacagtttatcccatgagttcttttaagaaggaatgaagggctgggcgcggtggcttatgcctgtaatcccagcactttgggaggccgaggcgggtggatcacaaggtcaggaggtcgagaccatcctggctaacacggtgaaaccccgtctctactaaaaatacaaaaaattagccaggggtggtggcggatgcctgtagtctcagctacttggagagaggctgaggcaggagaatggcgtgaacccaggaggcagagcttgcagtaagcggagatagcaccactgcagtatggcccaggtgaaagagtgagactccgtctcaaaaaaaaaaaaaaaaaaaagaatgaagaaggcagatgcaatgtgacagagatttactagatgatgtgctcgataacacccttcaactagaaaaaaaaattagcttctcttagaatgtgctatcggcatatattggcatacagtaattaagtgtaattgagaaaaggtaattctgagagggaataaaagcaccagatgggagatacggcattcactcttacctaagtcctacctaccttcaagacctggatgaaacatcacttcctccaaggagtcgttgacagacttaggccacagtgatcattgctgcttccaaacatctatggcatttgttgaccaagctatttatgttatactataaggaagcgttgacaaaaacgtggcagttttggtatctgggcaacattccgcaggggctaggattgtgtcatttattgtagtaaatccaatgtctcattcatttcctgtcacccagtaggccctcaggtttgttgccatggatgagttaacagatggcactgactcttggtggcactggagactgcagccatcagatgatgtttcaagagacactccactgtgatgacacatcctgaagacagggaaactaatgtcctttgagaagtacaaatgtctatttttatttcacgtagtattggcttgaaaagatacaaattcacttaggatgaaataaaagtgttctgtatttgaactttatttcaaattattatttcttggaggtttttattaggcaaccagttcctcctgtcttagaaagatgtagggacggagaagttctaaaaattctgggcctatccttcaaggttcaatctcatagtttcttcctcaggaaaacctcctctggccatcctagcagatagacatggcacttccatgtctgtccaattcccccaaaacatgacctaaggctcatctggaataagcaatcttcttctgtgtaaatattttataactatagcctattataaactatttgtttagaaaaaagactggaaaagtacacaccagaatgtagggtgtgtattttcccttcaaactcatttacctttgcagccctcttgaataatgtccttccaagccttttgaataacttttatgttgttgaatatttaaatcgtctccaatagtggtaatttttacagtctacaaacaacaaaaggtaattcaatgtcaagaacaattaataagatagatattcagagtggttgatatggtgagatgaggtttggtttccaaaaaatggttgttctaaaaggaaaccaatcatgtctatgtatgttatatgaatgttgagctctgtttggagttacccccatcatgaaggtgccctcaaccatagcagtgtcactaaaataaatgacaaggcaattttttggaaggtaatattgtctctgaattaaaaaaatggaaaatctttatgcctctctctctctctctctctccatccaatgacactaatgactacttcaggatgtctgaatattgtacttgcttatatatgttcactgcaaccaccatggcaatgaaacatgacaggtcctatagtggaaatcatggcgtggtcctccaaggttaaattggagggaaaccccaccatgaaatgcagtggctagatgctagatcttcactccactccccactcaccagcactgcttctggctttgggattgagcttccttctgggtgaagctcagaagagctcaaacttttctgagccaaggtcaagctgggaaccttgttacgctattttatttttaaatattcacttcccattatgtctgagtcttcagccacatcttgtttatctggtgaacgagtaaataacacacagtttctatgtcagtttcattcatcccatgttttattgagcacctgctgtaagccaggcattcacctggtgatcacttaaggcccatctccttgcttccagcttgcttccctataatagaggatttttttattctctttgagtatgagtgcacagcacacacacacacacacacacacctgttttgtattcaaactgagaatgctcatttatacacagctctcctcttaagcacacaaaaattaaggcatccaacaatcagataaggcaaatgcatttatcaagcatccagcgacaaaaagctcctagacgtctactacatgcagcactgctgttcgggtgctggggttatagcaggctacaagggaggcaggtctgcgttcatgccacctacattttaataagaggagaaaagaatagagaagcactgggcagctgctgaggagtgctaaggagaaaaatcaagggaggaacaaagagtgatgaggagtgttgatttcagaagtgagatcatggaaggtcgccctgttgaagggacatgtgaaagagaacctgaagaaaggtccagcaccatcaggatgtctccacgaaggtgacagtgtcttgtctaggtctgccttgccaccgagtcaccgactgtgagaattggaaggaatatcagcatccttcatttaacagttaggaaaataagaccaaaaagaggttacagtccaagttcagcttcacaaagacgtatctctagatagaagggaaaaaaaggagagcaagaaaatgttaaaagttgactatgcttagaaactgccaaaaatatttaacaaaatgtgccagaactagctgaaaaataagttcctgaatattcaatcaaatattctatatttaatttcatggtataagaatgcagtaatcgaataaatccttgctcttctcagcaaccacttacattgttttataaagttgatccacatcctatctttaggttgtagaaaaggatgctgggggagctgtcatcccagacccttaaatgtagttaatcccctggtaccaagcaaagctcagaatcttcaggacatctgcctctactaccttatgctagaccttagtatctagggagaatgacagcaacatcgtggtcatggttctgaggaaagcagtggaatgcacatcagaggaaaccaactaaacactcacctgtaatgagatgggaagtgattacactatttttcttcatggtatttatagttttaaggaacagctccctgtaagtgacatctacccactgccctttatcctcctattaaagcttttgtaacagatggtgtttatagaattggctactctgactgttagcactgtgaagacatgagtctatgaagaatgtaccccaattttcattacaccccagactaaagtgctaagtagtgatcttttgaatgaatggaatcccattgatagagagtcaattatgcctttgcattaacacacatcatcttttgttcattaactcagaaactagagtgagctggcagcctgagagccaaagagcttctgtgagactctcaagtgacttaacgtggctggccgatgactgattccttccaggtgaagcgctaagccccatcatgcccctgttcagctatggcagggttccaagtgggcagcccagctctcctctgggaggagcattgggcaccacttgagttgagtttgtccaggacctgagctgtattgttctgtgatgtgggacaatcttctcgagcagtatcaatgcttctgagtcacaagggtcaaaagagagttatttccctggggctacaactttctgagtttgcacaacttccagatgcagaattaatttcctgaggtcatctgcagcatggtgcagataggtcacttaccctgcaagcagtatggaaacctgatatctagaattgttgactattctgtgaaacttgtttctcatatcttatttcttcataatatcttgccccatcacatcttcaaggctttgtttgaccttatgggcactgagtaactttttccttttctgaatgcatttggcgtttactgttgaaatctatggcttctttagtgagtacttgccgagtgctcactgtgttcctttgaatggaggtagagtcctatgaaggataagtccttaaggcaggggctatttttatagtttagtatctatctttaacttcagtttggctggagaactaagatacattaaaagaaacttggcagtggggggtggctcacgcctataatcccagcattttgggagaccaaggcaagtggatcgcctgagctcaagagtttgagactagcctgggcaacatggtgagatgctgtctctattaaaaatataaaaattagctgggcatggtggtatgtgcctgttgtcccagctaatttggagggtgaggtggtaggattgcttgagcccggggagggggaggttacagtgagccaagatcgcaccactgcactccagcctgggtgacaaagtgagacccccatctcaaagaaagaaagaaagaaagaaaaaaaaaactcaagctcctcaaaggtggaaaatttatatataagatagctggaaaaataagactaagtaaatttgctttgtaatgtttacaataccgtatgtgtttagtgtctggatgaagaatgaataggttccgggcatgataatattttctttgagcacaaatatgttttatgattgtcagaaccagtgtggaaaattactaaagaaactaaatattcttttgcaaatgcacagtattttgacattttcatttcaaatcaagatgctggaataaggattcccccaaaacctgtaaaactcagcgcagatcccagcaatagatggggttgtgtgtccttgctagctcattgcggattgggggccagctgcactgaggatggccttagctccctgtctgctgagagcaggatgaaatcaatgactgactgatgtctcctaagtgcctgatatatggttgctgatgcagagaggttctggtgacagcccacactgagggatgcttatggagggcccaagtaggcgagagaatgcaccctgcgtatgtatgtggaagccaaggatccagctggcaagttggcaccagccaggctgagtacagaggttccagtctctacatcagaagagccgagtttcctgacctagagaagttattttggctttcaagttttcatctttaataagaagggtttggaataaaagaaggaatactgacaatagctgacgtttcctggatacttatgggtgccagctgctcttcttcgcgtattcatctgtgcaatccaaacagcactctatggctagaggccactgcgacctctcttttctaggcataaacctgagtccctggcccagggtcacagctggcaggctgggcactgacggactccaggctttaagtcacattgctacactgtactcagggtatctgccgcccgggcccagacccagagatccaccctaagggcgaggataaggagacagaggacaggcagatgacaaggtgggggcagttctcatgaagggtttccttcttggacactgatttcttcccaggatgcctgaggatgctgaccagctccttccatccctgtcctcctcacctctttccacatcccctgcagatcagcccagcagtgaggcacagcctagggtcggatgtcccatagatcatcatggaagctcagaagcaatccgttcttcattttagaggctcctctccgtcaagattctggaaacacaggagaacactgtgacctttctcagaggatgttttcctaacatgcctgggaggaagacttgaatggtggtgtgaaaatgtcttttcatgccctaatcaatagcccatcaattatgtatgtacttatgtatgtaaaccctgttaccatcctgtggagaggataggacttggtgatgtccaactattgagctctttcttcaaagtcttaaaggaagttcagtacataaaaccatggcagcgggttggctctggcagagtggagtcagtcagacatctggagcgctgtcctcactctgcctccccaccctcgggcatgcttgttggaactgacagctccactgctggcagtttataaatctttccagtgttttcattgagggttgtcaaaatgttaaggcatattaggccatcatggagcaaggtaacctccaaggcctttacctcttctaaataatgctttattctcttttcttctggtcatgaagatacagttggaaattcctacagattggctttgcttgaaaggctattgtagaccattaatgggcgaaatccctgtatttgaaattgtaagatgcaatgagggaaggcaatccacgtgatttccttgtgttcccctagtggagtgaaaacagatactgacgattgtttcctcattcctggtggcatcttgagatggtttggtaacatccaagctgtgcagatgttaccacggagcatggaggcttttctgaactcctacaggtttcattgtctgtgccactttttggtacttaccatttacgtatttgaactgtgtattgtttcacaggtgtgtgttttccaagttgccactctaccaaccctttttgtatattcctgagttcaaaaagcactttaaggaaacaaactgacaaaaacatgcagtttaagaggaggaaacaggaagatggctcacatgtagcttgagtgaacaatcacatttagcacagtgcaggctttcagtcttttcatgtcatgcgtatttttgtatcctacggacaatgagccttgactgcttttttaggcctcttaccagcttcctcctctgaagtgtagtaagtagcttcctatataatataatttgtagatgactaaaagcaaggcctgatcccacatatctcttttatagacctgctacattgccagaaaggtcttcattgctcaaccttacacccctcaaggataaaagctttctcaaccacaagaattcctgcagaatttggctatgtctcattcattattgtacggggtcagtcgctggcccaatatctaggctatagtaggtatctctaaactattgggaaacctgtagtcatttggtggcttatttttcagtgagtgcagataggagatggaatatgggtggatctagatggatagagttggatcacaaagtgaaaaccatcacttggtgggaccatgttggggaggatcctgaggatgctgaggtcagtccatgacgtctgtgacaggcacatgagggaggggccatgtcatatgtgtctcaatttgccatctctgcttagagcctgagtgactgcttgagaaggtaggcccaagcccagaggacagagcatatgagggtggatttgactgagagagttggtaacacactttctaagtgagaaatacggatgacaggaacaccctgcctctgcccgtggcccagctctgcttgagtctgtcactgtctcctttcctggaaatgtcagtgtcgcttccctcatgcgttttggagccttgagttcaggctaaaacagggccttttgaggggaggagaaaaaaggaaagagggcaaaaggatgaagtgtgatttcttaaacaggtttttaagaaaggagaaaagggccttgcttaattttgagacttccaaaaggttaggctacatgtaaagggaaaggtgaggttgatgctggttttacaagaactgctttgctcagttctacttggttcttatcaacgtcggtgacccgcagaactccttacgaagcagtctagtggctacaggatagcatccaaagtgactgcttagagtttatgaatcttcactaatgtgtgtgtcccagataacaggatggaaggaaaaaaaatgaaacctgtgtagacactgagtatgttagtttggaacagtgaggaaagctttaagagagaaatcagtattatatcagtttagccaggctcacaatcaatagtcatttgataaaagctgagcgtgtgtgacactctcctaacacagagtcctgtgattctttggggatgtctttgctggtgtatcagatagctattgctatgcaagcaccccaagacttagtgggcttaagacagcatcatgttatgaaaatcatgcattttcatctttaataagaagggtttggaataaaagaaggaatactgactattccttctgaatattggatgatctggggtgtgcctcactgtgtgtcagctcactggcttgcttgcttctgcctgggaagtggccttgccaggggcatcttttctgagcagggctgctccatgcatctctccttctctgcctcctgggactgggaggcatggtccttgcatggccatgacaagcgcatgcaagctctcctgagacttaagctcagaacaggccctggaacttccccctcatttctgtggctccaaggaagccccatggccaaagaatggggaaataggctctatcccttttgcagaagtaactgcaatgtacacagactgtaagtaaagggaaccatgaagaattgaggccgttagtgcaattaacatgcttagattactcttaagctcttattgttgctattagtgatctctctggaccctggaaatgtccagcaaggctttaggatggtagctgtagtagaagcatgagtggatagtcatgacctgcttttatcctcactgtcaatgtttttctttccatacattgttgaggttaagtttgctgaatggtaaagaagtataatttttgaaattgttttctgtcgtcagttagtaaatcaatcaacatttactgcacagctactggaggagcagcacctgctacttcctgggttcatggagccataggggtgaggagggtgacatttactgagtaatcacttcgtgtcaggaactgtgccaagaacctcgtaaactccagattaattgagatagacattttggtggggagatatctatgcattgttttattgttagatcaggcataatatatccaaagtgtaaagtctttggaaactctcgatgaaggaaagggattcagtttccaaggtgtgggctagaatgcagaaaataaaaatgtgtaagtgaaggttttctgtggctttggtaatggctgtgtttttgatatatagtaaacaatgataaatcgttgttcttttaactctgaattttttttaaaagaatgtcactgtgcacggtttgaagctgcaaagattgccttcgagagggaggagtcatttctccacgtccctataacattatgtggaatgttgtctgtcagctttggactgtagtttatatgtcagtgactgtagtttatatggagtattttgtttaacttttcatttgttcccaatgttacaattttgctttctcatagatatgcatatggaaccaatgcactaataaggttcatttctcctaatatatgctgtctgtacatttgtcgcctataatagttgttaatggttttaaagagggtcatgatagtccgttatgtcaaaagatgccattgccttctgtctttttctgtgcattcctggttttgaaaatgagggtacaatcagacctgaaaaaaaaaagcatatgactttgtttcatgacctacaaaaagtaatggtaagcaagatgcaaattcttattctccaagggtatatacactgtcaaacaattgaaagaagccaagactatctgaaaaggcctatttttcagatttcatcttggagacctttcatcatagttcctaccccaagaaaataactaatttgctctagccttatggaatagcctggaatggctgcctgggccatctgagaagttggctggtcctatccagggcttccccagttggcctggctttgctcaggggccgggggctgaactttagcaggttccactagtgctgttgggagctccacagagaaaggtcgaacgcttggtggtttgtccttgtggtcagaccccgggatttgacttttaagaatactctgaaaatgaaaatggatttcctgggaaggaagtatgtgaagtcattaacattaattaatagcttatcgaaaaattaggctttcaggctggaagaaagtaggcaggcctgaagaagggagctcaggaaggagagctggagggaccacagcagggagctggcccagaggcaggtgacgtcgcccaggaggctggacctcggggattgtggttctgtcaagaaaggatggttgctggtgggggctggggggctgtgggggctgggggtgctggagcagggaggtgtgacccaccccagggaataggaggagagaagtgggtagggttttcttggactctcacttcaccttccggttggacgagctgcaagcatgagcttctaagctttgcatcccagagtgttggcggctatggagatcctgcgggcctcactgccgccattccccatggccactcagccagcactacctaggcactgagctccgtgagggacttttttcctgctcaccttatctcaatggggtcaggcgggctgaagcttctggagtcttggtgaggctgttgctggattgaatatgagcagctgcagggctggaggaacccaaatctcagtggagcctgttcattgaagaccttactgataggttagtgccaaggggtgctgacaggtacagttatggggaactggcacatacgaggtagcagcatctgccctgaccttggccctataatcatccgtggcattgttgagaacagataaacagtaaccaacagtgggctcacatcacagatgttttcccttggtgcttggtgggccccaagatgttggggttcaaggtttttattatgtctagggagggccagaatcagtcctatctgctcgcattgagatggcctttgttcaagcaagaggtgaaattaagtgtccagaggcagaaatagatttcactctgggttctgttatccatggttctttgtagattctttctgaatgtccacaggtgtgctcaactgctaaattcagctgcctttgaaatcacaaaaagggctcaacaagtggaggtctcttccaccagcaaagcaaaggattgtgtaattcgatcactagggtaggctctgaggctgcgtggcccgagttgaaagctgagctctgcacggacagctggtgggtctctgcctaagttattttacctatctgtgctctgcttcctctcctcaccagaaaaccgaggctatggttgtatttgcatcataaggttaccaagaaaatgcaataagctaatgtacagggagcacttaaaagactatctgcacgcaggaagccctcgataactaattgtttgctgtaattattaatggtcaccccacatataggtgaggaaatcttgaattgccctggttggtgctgctgggtatttggctcaggtaagagtggtatagcagcttggctttttttagatgagaagctacctccccctgaaagggggctgagtttttgtctcctacagctgctcccctgagaagatattcagctcttcccaaactactggttgtttagaaggtggctgtgtacagagcctggtcatgctatgggtcacagagacacagggccactgcctgcacccacctggacagcacccttctgtgtgacttccatggggaggactgtgagtggtgccccagtgttgggatagggaccagatgactgcagaggaaacaccattaacatttgtctattcagcaaacactttactctcacatgaatgtcgatgtatctttgggcttcttataaaagaatcccacattcactcaacgtctgtgagtatagacattgttatttgttcctttcactttttaaagtgaattaatttgtacaatagtggttttcaaagtttgttgttcttgaaaaatcaccgatcaagcattaaaaatgcacacactggggtctcacccctgagaagctgctctgcttggtcattcaggaaaactcaggtacctacattttaaaaaaaattctcagatgagctgccaggcaaaatcacctctaattgcttctcttgttttagttctcccaacaacctgtaagagaaaattggacagatattcctgtccccattttagatgaggccgcaagtacttagagtgaaaatttgtttgaggtcacataattagttaacatattattccagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggctcagcgagatgcaacggagtgtgggcagtgtcctcccggatgttcagaagaaaaggaccctgctgaacacatgcagtagtttccaccactattaatgaccgtaaggcaatgaatctaaatagtgaaaatctttgcatgaaacctatgcttttactgacattgtattgttgcaacaatccagggatgtagttatgtatctccctattgtttaaggatgataaaacagattcagagaatttaagtgacttgcaaaagtccacacccctgagaaacaagagagccagagaacccgtgggcagctctcagctctggcgccagggctgtgtggttgggacatacccattgaccttggaggcagaacaaagctggtatcaaaactcagatttcttgactgccatttcagtgtactttttccactacaagatatttcttactgttttgagcatgctgtattaccacagggactagcgacataggtttaagcaagtcttcagtgactgaaggagaaaaacatgtagtaaatattgcttaaatcttttctcattaccacatagaaacacatttctatgtagaagtagaagacatttctacttacctatcctgagaaccttctctctgaaaagctcacagcagagtccatctctcccgcttggcagctgcaataagtacagtaattaggaatattatttcttttctttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgccactacgcccggctaattttttttttgtatttttagtagagacggggtttcaccgtgttagccaggatggtctcgatctcctgacctcgtgatccgcccgcctcggcctcccaaagtgctgggattacaggcgtgagccaccgcgcccggccaggaatattatttctaactcacaagagttcttctgcatgttagccaccccccagagaaaatagtctccattgttgttctctcttcagcatatcccaggtatgtttccaagcaagttttgctccactataagttgatgaggacctttttttttggaagctgatggcctggcaagagttagtcttaataggttgtgtttcttctcactttagctggctctccctaatgataatgtctgttcaagttgagcccagtttcagccagtttctctgggagtcaaaagcctgtagcacacccagagagccaccacctgtccacagcatatggtctgaaggcatctctgctgctctagcctgaccagccagcccaggatttccaactgtgagctcaccctccttgtaaggcaaacagggtttagccagcgctcaccttgacctggtgacctttgaagattgaggttgcaggagaatgcaattgagaatgcagcgggtttccagaccccatgtgagccatccctgatgcttcaccctggctccatgggaaggaacccagagccctgcctggctggtctcctgctaatgagatggaaagcaggggtcctggccacaccatgaaactcatgatgttctccactcttgtgtccctgccatggctcacattcagtaattagataccagctcattaattcctgctattctttcagaagggaaaggatggtgccctttgttctgctctgctgggccctgagccctcacagcatgaagtagctagattctgcctcactccagaggcggctgccactttctcaccccacagtcagcccctcaaccatgaaaagatgtaaggatgtagctaaattacataacccaagcatgaaagcacctgacgtgtatgaaaccatgttctcagacacttgtaggcagtgacaactttataattaggcatttcatccaacttatgtatcttacatagggaaattgacatcttagcaaaatttatttgcctaaagtcgcataggtaattaaaagtagatacagctgagactagttgctataatgcccagctaggagggagtcggtggaagaggtgtcatctattttcctttgaaggtttgtaagtatttgacttttcctgccctgagactgacttgcctctgaggaggcccatccgacttagcttgaacaacccggattcttgtctttagtcaaaagcctctaaataaagaatacaaatcagcttaacttctccaaggtctggcaaagctttatacacctttcagaaacagaacacagcaaatctgcctcagcaaacatgtgcatacgactttcatctgagctatcaggaaggcatcttatagacacatacaacggaagcccagagggctctggcatgttgcaaaatcaaacagtccagaaaactttccaccccagaccactattcagttgtcatctgaaataatggaagtcagagtcaaactcatcaattaaacgagaattatttatttatcataatctctactgcctgctgcttcaaatgctttctcatgaattaatgagctcatctacgtgcatgtcaatattttgttttaaactacaaaataaaacacaggattaggttttgttctcagtgtctacctttctgtggcattgatgcagatagcaactaaggattaaatcacagaatggttccctttttaatttatttatagaaatgggcttttgcttttattagtgatgaatgaagagagcttgacttggggaaatttagactgagattattgaagtggcctagagtttggaaatttttataaaacccaactgtgcaagtggattgaaattgtgcttaagaacaggctttcatgccagacttgtgccgaattccatttggttcctggcagaaaacccttgaagaatggtatttggttttgtttatttggcatttcaaatactggttcatctggcccccatcctgatcaaaaatagtcagaagtagaaatgggtacttgagtggcagcagagtggattcatctgggcatggcagcacctagcgtaggtctccaatatgccattgagaatgttgttgagtgcaggataacctttaacataatacccctatccctctcctgtttccttgctggttgatcatctgccctgggccacaaatagctctccctctccactctcccaaggaagaaagtcctgacaaattactcccttaacccagctctgttcctgaaggcttgcatattccatcacagaacttcctcttgggatggagagtaatgttgggacagatgactgtcctactttctagcaatgaaaaatgattgcatgaagcctcacattcctgatgctaatgagaatctgtcctttcagctggcgtttgcatcaggagatgccactgcttgatttgtaatgttttgcactaacactctgagtgaaccctgtctttgggccgttccattgcacaataggcagttgaaatctatgcttttctcaatagggagtacaaaaaattcatcattttaaagtgggctgtcagatctaagaaataaatctcagttcataaacttgaaaaactcagaagtgttaaaaattttattcactaagaacataacatccaagacgagagatcaattttgcatattattatttctacctgaagtattccatctcacttaaaagaaatatttgtttggaagcattggttggtgctggtagccaaggctgtccaacaaaaaaagcgagtttttaaagaaaatgttattccctaagggtgaatcttaaaaaattgccaaatgtattcttgagatgaataacaggaagcttagttctagaaagggcctgagtgattatcgaatccattcttcatttcacagacgagaaaatgagtttcagagatgcaaacattcctactatcacagaactagtaagctggagaacagacattaagacctgtaatagtgattcccgtgtgaatgtttttatgatgaaactgtacaaaatgatagaacaataacaatgtcaaaacacctatcactaagcactttcatatgtaatatctttttttaattataacaaaatggcaaagtaggtgttatctccatttcacaaatggtacaactgaggctcagaaacattaagcaactgtcctggggtcacaaagaagacactattagagccaggtttagtccacatattcaatttctttgtttatttccttcactttgcatgagaattcctttttgctgtctttcatttttaagcagaaacctttctttaaagacactaatgatcaaagatctaaattaaaaactaaaactattaaatttctagaggaaatcatagccctacatctaatatataatagaaccagatggaaattctagaaaattctgaaaagtacaatatctgaaaaggaagacaatacttagcttggattaggcaatttgtttcttagatgtgacaccaaatgcacaaagaacaaagggaaaacaagataaattgggcatttttgaaattaaaaacttttgtgcatcaaacaccattaaggaaatgaaaagacaattcatagaatgggagaacacttttgcaaattgaatatctgacaagagacttgtatctggaatctattaagaatgctatataattcaataacaaactgacaagtaaccctattgaaaatgggagtaccaagtataccttttcatttaaatcattgaacagttcacaatggctgttgtaaagtttttgccttgttactgaaaccatcatctcttggtctatttctatggagttattttttcctagttattggcagtttgcttatcttttatgtgtctaataacttttaattgaatgtagaacattatggatcttatatttttgagaatctgaatgtttaaaattcctttgaagagtttgtgttttcttctggaggcagtttacttactggctgtgagctcagtcctgttgaggctgtttcacgacaggctgtggctttgtcagggtgggtgtggatcagacatctggtcatcaaccctgcatattccagcctctttcacaggctcactcgctgatttctgtttctcccacattaaggccactgctctctgatagtctctgcctctcccaggctggaaaacagccttaagcagagagcccttgcaagtgaggagccccctcatgcttcccccttcacctccagggtcatagtcctgtagcgtatgtaatccccttcctaaaaacacttgctttatatatttccctagttgtgtaattgtttatagtgagagaggaagcctggttactcatgactctattatgagaagaaccacaaatctctcctacttcattttaatcattcgatgttagatgtatttaaccactttgttgccatgtttaaatttttatggggagaagcccaaggtaaataataaaattaacaaaacttttagtccagtgtgtattcctcagagaaacctcaggtttcttttcttttttttttttttttaacaaattcaggtctttgttctagaagttaaaaaaaaacaacatacaaccaaatatagttaaaacaggaaaatctatttgtgtttacttcatatctttctgttgggtcagatgataatgtttagaaaaatactgtaacattcttactttatgtggacaaacctttagaggctggcctctctgtagaaggattgcacagggaaataattttgagcctactttcttgtctttatcttctatgttctcttctcagcttcctgtcttgattggcatggaacttgctctgctcctcatgtttctatttgtttaggaaattcactaggagtgtacaagggacagattgtcagctgtcatccaagtccctttcaaataaccccactatcctttgccttaggaagtctgagcctccatcagatcccggtcacattgtgagggaggagtgaccagccaccgagggccacctcctgctcttctttcctctctcccctttgcccttgaggtgccctcaactcccaggctctctaatcatgctcttcccagcccaggattgccctggccagtgcagctcttccttaggttctagaaccactacctaatacctaattccaatagggtccttttgactgaagctgacttaatgtgtttgagaaagcagggctaaaataaaaagaccctaatgtagcagaggccttgataaattctaccgaagtgatgagaactgtgggaatttctgactgagcccaaaagttattagaggcaagaatacttctctctccagtaaatgcctccccacctccacccccatttatagaaactttcaaatttatactagcataaggccaaccttatctgtgaccatgaataagctatttcactacctcgttgttctggtcaaaataatgcatggggctgggctcatgcctgtaatcccagcactttgggaggctgaggcaggtggatcacttgaggtcaggagttcgagaccaacctgcccaacatggtgaaaccccagctctactaaaaatacaaaaattaaccatgtgtggtggcacacgcgtgtagtcccagctacttgggaggctgaggcacgagaatcgcttattgcttgaacctgggagacggaggttgtagtgagccgagattttgccactgcactcgagcctgggtgacagagtgagactctgtgtcaaaaaaaaagaagaaagaaaaaagaaaaaaaaatcatgggctagctactctgcttgtattttttgtttctgtccatcctcttacttgatacccctccacgttctaaaaacaaagcctcccttcacattttgagtgtgtctgctatggataatgaggcagcaatcctggttctaaagaattgtgataaagcagtcactaaggatcccattaaaggtcaaaccatctaattcttaatctcacggcacctgcttgataatgatggatacttattaaactcattccttctgggtctcagaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagttttcaaagtgcccatctgaccactccactctgatgtctaacatgtgctcgcttacatgtggccagaagagagctcctcatccccatggccatcgctcctccaccagtgttccatctcagtaaatggcaccaccaccaacccaggtgctcaagccacaagccctggagttgtcgttcgttcactttccatttcacctcatctaaccattcagcaagcctcatcgatcccatctccaaaatatacccctaatccatgcagtacacccacctccccactggggctgcaccagtccagccccagccactgttgtctctcactggaatctctgaagtcactcccaagaggtccctgcttccactccccctcccacacccattctccctaagacagccacagggatcctgttgaaacaagtcagatccatcaccccctggagtacctggcctcctttgcacatctcagaccgaagctccttactgacctctaatggtgtgcacgccctgttcctcggcccttataagaccccttttccctgcacactccatgctctggccatatcggcccacgttctattcctcgaatatatcacattccttctgcatcagtgcctttgctcctctgccccgaaggctctctcatagatcttcccgccattcaagtcagccccatgatacctccgcagtgacgcattccttgaccactctacctaaaatctctctccccccgccacacaatctctttgtcttgttttatcttcttctcaacacgtatcactatcaagacattgaacaaggaaatactgacggattttcatttcagtttcccccttagagaaggacattgtctattgttttttgctatatctgcaatgtgcttggtagttaggaagcattatataacaattttaaaaatggaaacattcagtttttaaagtaggtttattttttttttttttcagagaagccaagtaactggtatgcgtagtaataaaacatctcaataaagaattacaagacttgaggatctgggcatggtggctcacacatgtaatcccagcactttgtgaggctgaggtgggaggattgcttgagcccaggaattcgagaccagcttgggaaacatagcaagaccccaagtctacaaaggtttttggaaaaaaattagctgggtgtgcagatatatcttcaacatactgatttgctctattttggatatatacccagctgagagattgatcatttggtagttttagattttgggggaactttcatactgttttccacactggctgtactaatttaattcccaccaacagtgcacaagtgtttccctttctacacatcctctccaataaaagccacttcattttgagccattagtgaactgagagaaaacagcactatggagggagaaagtggattgtttccaagaagtaggtgggcaaggagcaatgaaggaaagataataccaaggcaaatacctggaggatgttaagccaagagcatcagaggagaaaaggaatcatcaagaggttggttagtgggtacaaacgtgcagttagaaggaataagtaatagtgttccacagcacagtagggtgactatagttaacaatatatgttttttttgagacagggtctcactctgtcacctaggtgggagtgaagtggtgcaatcatgtctcactgcagcctcaacctcctaaacacaagtgttcctcttgcctcagcctcccgagtaactgggaccacagcatgtgcccaccaagcccagctaattttttgagtttttgtagagatggggtttcactgtgttgccctggctgagcttgaactcctgggttctaagtgattgtccctcctcgacctcccaaagtgctgggattacagatgggattacagactgagccaccgtgcccagtcaacaataatttattgtatatttcaaaatatctagaggaggctgggcatggtggctcacacttataatcccagcactttgggaggctgaggattgtttgaggtcaggagtttgagaccagcctggacaacatagtacgggcctgtctctacaaaaaaagaaaattcaaaaacttagttgggcatggtggtatgtgcctgtagtcccagctactcaggaggctgaggcatgaagattgcttgagcccggaattttaaggttgcagtgagctatgatggcaccactgcactccagcctgggtgacagagtgagcccttgtcctaaaaaaaataaaaaaaaaataaaaaaataaaaaaaaaaaaaagaaaaatataaagaaagaattagaatacttgaaacctagccaaaaccttatccttacttagggtgatcctgtgcttccatttgctaatccatagatactcctaatatcttccttctcttcttcataagtgaggagataagatgaaataaggaattcgtaaatacaaagagagtcataaagcatcacataaatgttatgtttattttatattgaaatgtccacctgaaaaactttctctggcagagtgcagggccagatgaaattcacatgaaggaggaacacctgatctgtatggccctgtcattattatgcatacccatggaaccagctgggcactcagggttatatgtggtagccacagcagggtgatttgcaacccccactcctatatccatcaagacaaggccaccacgaggccccctatcctgctgtagatgacctgaaatacgctgtccccttagaggttgctttctttggaattgatcatgaacatctgtttggtttattgcagaacccacagaggccaacacagtgcctggcacattctaattgctcaatgatcttgagatcaataagggggtgaaaaatggctgctggtgtaaaaagcaggagaaaggcactgaaaggggatgagagtggacaccggagaccattttttgcccatttgttagtatttcatccactctgcaactagtctcccagtcattcctttatttttcccctgtatgagttgaagacgactctttgtggagtctaggaacaggcaagtgtccctatatatggaaaggaaggaacagttcacaagctttctaagctcacaacccagcttgtctgggcttttcaatagagtggttgccatgacattacataggagagcctttcaggcagttcccattgctaagggcaaagggtgactgtgatattaaaagaagcatttgttgctctttatactcagaggaaatcaaggtgaacttgaactcattaaaagcaaggctgagcacatttgcatgagcagaatgtaaatacaggaggcttcttgcagatgagcttctctcttgcagaagaagagacccagggcctcctgagcctgtttgttcttaattaagagagatccttttgggatgagagtgagtttgtaatggcatttctaccacaatgtacaacttctcaaatatctccttcccccatatcttcaaagttttaagtacagcccttagtgcaagtttgtaggggaaatatggaaaaatgcaaaacaaatacaataaacagagaaaacaatttaaaatgattctacacacaaatgaataatttaaacctccatcatgtttgctatctgtgatgcatctatttaatattaataacttgtgaagaaaaatgactgtcaccatttttaacaagcctagtctattctggctacaaaccttagatgactgactattcctaacagggccctgcttattaagagtctgttatcttctttaaatttaatttcatgaataatgaaatgtttataagaggaaaacaaatatcctgtctaaagccagcctctccttactcccttccacctctgtcaaatatttatctgcctctaccttcttcctttttcttttcttttctcttttctctcttctctttctatttcttctttctttctcccttccttcccttttttctttatctatctatttcttcctctctctcttccttccctccttccctcccttcctccctccctatctctctatccctctccctttctttcttttcttagttttcaacaccaggctccatatttaatgcacacagtgtaactagcttcaatagctgatcattctttctccagagatgtcttattacgaagcaaggagcacatacaaagcagttgtattgcttttcaaattccctcttcagtgaacatagtcattaaagaattgtatcaagaagaaacacttttataatgtggctgtccccaaattctaaagatggtgttattattgatttagtaatagcttacaaatcatgacccaaaattagttcttctgcacttatgccccaacctttgtaaaatctttattgaacaaccatggccagtaaccataacagataatgttctattaagtgcagtttttccatgggtcatataaagtctttttcttggagctcatataagagtccatggaaccttcattcactttggtgtctgcagggaactcttttcctgtggagtctgagtgatcacgtggaatctcaccccatgctgcccacagaactgtccatctaggtgtctcttgctgaccagactctgggtgtacagcagagctgacagcccaggtttcaaataaaactttccagaatttcacacacacacaaacacacacacacacacactcatacagcagctctgctgtctaagatgtcaagatgtcgttttgggttttatttgtttacattctgaattctgtgtccatgtgttttaaattttcctctagataaaagcgtgatagagcatctctgtggggaattgctgtgaagaagtcccactgtgggatgtggtgcagggtgaagatgcagatgagagaaggaaggagaaagctcagggagagggaagtagaaagaaggggaagaataaacggttggagaagctgcctgatgactttgagcttttgtagatcagcggatccaaacctcttgttgtgcaggaagtgttagagaacattaaaagattagcctagagtctcaggtagttcaagagtcagagttgggaccaggtcttctggttctgatccagagctttttctcctacttagctgtcattcccatgccattcatgtcatgttttaagcagttcagcaagcattcttgccgtgctgacttgtctctagcatgatgttcaagctctgaaaattgcaagtgaatttaaatagcctctgacctcagtgagctcaaattctcactgtggagatgacctccagccccaaaacagatcagagacctgctatgtaacacatggggcaagtgcaagagtgaaaggaggaggatttggggatctagaaaggtctggggcaaagcggcaagagaaacatgaggcatttaggggtgaacttggtggaagggggaaggcagagctgggaaaagggcaagactccttggtgaccaaatgggtagacatgtgacaaatcactgcccccattgtggaggatacaatgtggaaagagctgtgagcctctccccaggaagctgtggtccacatggatgatgatggggagatgtgggaaacgccaggcagagaggaagagagctgccggggaatagcatcattccaccaacggaggaccacagggcttggtgtaacacccacatgcagagggtaagacgaggacccatcccatcatcagcggtgccaacgcttacattgcagcaccttaccactcagagtgaggcttcagcactctgcgaacgtttgctgctgttattcattgatcacccatgcacctcacaacagccgtgcgagactgattgggctgtcaccactttctccatttagtggacgaggacaggaagtcacaaaatgggcctgagatcttagagtttgccaagtcctgcagccatatgtaagtttccctgatgccggtactcaggggtgctgtgctacttcagtgtctgctcctcccagagtgctgtagcccaggagaagaggcctttgtgccatgctttttacagcagcacctccagaagtcacgtaagagacctggcacttccagaatcctttccagcctacaaccattttcacataaaaatgggaaaaatggaggcagaggaaaccatatatcccaaacgagggccagttatcccctgtgtatgtggggctgaaggctcatgatgcagtgaaggaccaccatttccctccttccagtgtattaagaagacatctgggtgttccagttccatcagctcactcatccttcagtagagacaagtgagcttggcacgtggatatgtgaagtgctgtgtgcattcagcctcagtctcctatggtgtcccagctcctggactctaagcctccctgtttcatttatcaaagagattggatgacacccacctatgttggtgagaatggatcttcttcatctacccattcaaatgctcatcttttctagaaacaccctcatggacacaatccagaaataatgtcctaccagctatctgggcatcccattggccggtcaagttgatatccagaattcgctatctcagctgttaaggccaactcagatctaaggggaggagaattcaactccccctctcaatgggaggaatcctagaactgctagagtttcctgccaaccaacattcttaccaagtaaaataaaacaagaataaactttacattcggctacagaaggtgatggaagaggtagagcaagaggatctacaaagatgctaatttcatttataattattttgtgatggaaaaagtaataaattattatgagttgtcaccagactctttcttaaccagagaattctctttctttggaaaaatattttgaaaagctgcttgaccatggcaagtgagacattgaggacccaagcaacagatagatggtttatggcatgctgagtggagagtaggggacacttgcatttgcctttgggagggaaggagagaggaagaaatagaaaaaaaaggggaagaaactggagaatgtgaaagatgtgaagcatcatgggaaagtagaggccgggaaaaacatcctagtgataaaggtagaagaaaagagttttaggcaatgcctaatatgtgattgaaagatgcatgtcccccttcctgccatggatgctcccccctgaaattttaaggcaaattttatagactaacggttgccctgtgcaagtgttgtcttgtgtgtatgtgtggagtgtgaagttggggttgcagctgaattgcacctccagttcatcatgacttcgtatctcattgcatagtctggaaaaaggacaggcatagacaaaggaactcaccagcagaggtggccagaagaagaaatctttcctggcaattgaaagaaatcttagtgcagattgtggtcttgcactaggatgagacagaggttggagcttgtcttcctcagacatcaaagagcggggagaacccaactgccaactggtttgcatgtggcttgtggtttgacagctgactctttcttaacttctaatccaagggtcagtacaaagccaattccccttctcctccaggaggaagaaccttctacagcctgaggtacccagtacttgtcctgagtgtaagctaggatgacctctggatccatcatgctatatttagtctctgtttcacctaacactcaggattccatgaatgtacctttagtgagtccaggacaccttgtgaagattgcacgaaccctgcctgggaagtgacaaaggtgcagacttacccttggcatcttttgtacctttaaccacagagttcacatggagttgtgaccccagctcatgtaacctaatgcaaggtgaataatacctcctacagcaggctctggaaatgtttcttgtctgcacacacacacacacacacacacacacacacacacacacacacttcttaagtctgcattccccaaataataataaggggcatgttgctctataacaatcagcatcacgaaagcctacaggactttgccattcggtttaatggaattggtatatttgaaatactgcctttggaatttttttttgacagagtttcactcttgttgcccaggctggagtccaatggtacgatctcagctcattgcaacctccgcctcctgggttcaagtgattctcctgcctcagcctcccaagtagctggaattacaggtgcctaccaccatgctcggctaattttttgtattttaatacagacagggtttcaccatgttggccaggctggtctcgaactcctgatctcaggtgattcgctcgccttggcctcccaaagtgctgggattacaggtgtgaaccactgcctctggtctgcctttagatattttacataacagattgtattacaaagacctacacgcctccaaaaatactttggaatgttttaattatgcaaaaattgagaaaatagttaggaaagatgcatctgtctctgttaagaataaattcaattattagaatttaggggtgcccaacagcttacctgcagcaagattaggttgagttctactaccttcaaatgcttacctatgacctttgaagttctgattattctgggagcttctggtgctacatccactcaatctgccaggagaggaatttatcctacaggctgcataatttccttctcagctgtaaaatatctctttataagaggtgtgggcgagaaggaattatgggagcaaatacagtatttatcacttgaattaaacgactaaacctggcaaatagttcagctatcgatccacaaatagtatcaatccacaaattagcagcctgattcagataatctgatcagtagatatagttatatgtgagcatcataagcatcaaagccacttttatgtgtattatttttcttgtcacccacaaatcatgttgcaaagattgatagtaattgaataaattgccatgtgtacttaaagactgggcttgttggagacacaacacatttattagatgatcagttttttttttcctgttatgtcaatgctcactggaacacttcttttcaaatgtaggaaaaccaagctaactagatctagaaaaacaagcagaggtttcaagggatgcctttgaaaggtggtgtggtatcagggagcacgttgaattggaagtcagatgtccatgtgtggattcctttcatggcactccctgattgagacaatctgtaaaatccctttaacgtgcgtatgttatgattgcataatgtaattcttgtttagggtttattgtgtgactctttgctaagtaactgtactgtcataaatggagtccgagcagcggggcttgtctccccgtgagtgtgagatctgcatgctgccacctttctcctcctacttttctcgccaggtaccacagtctgtgtaagatgcaccaggctgatattttgtaaaatcaaggtcttcaccttccatttatgtggcacgagctggaatttgccagggtcaaatagtcaaccaggagttctttatggattcagccacatgggagaacttgagggaccttgcatgtcttatattctccaaaactccatccccacaggcttgccagtgtccaaaaggcctgatttttgggggaggaggcagctctaaaatagtgtcaattctagaactccttttttaaatgtcccaggaggagtaactattggcatcatcagtatttaaaactttgggctaattacatcacctgattatttccctcctttgtgctttctagagggatataaaccaatgagagtcttgagaggtggagtcagttcagctcagaagacactatcttgagggaaaaggccatgatgagtgggtttgtatgttgaattggaaagaggagaagggagatgaagagaaatagggtagggggagtactgagaggaaggatctgaagggtgatagagagaatgctgcctttggttaaaatttcaccagtgtagactgtgtttatgtagcttagtcagaatctcccttcatcctgtagtgctatgtttttgtttatttatgcaatactcttcctgtcaactatcacaattaagaatccctagtgtagcacagttatgaatgtggctgacctttcttaaaataatgtcctcgagctctgtagcactttaaacatttcaactcttttgcatatttggtttttcataatgtaggttgtaacacgatagaaggttagggaattaattgagtgggccatgatcagcttaagaaaataaaatgcaatagaaatatacctagtgcataataactagtagaatgaactaatatgaaactttgtccattatctatgtatgtagtatgtgtttactgtattgctatataaaatatatttctcatagtagattgcagtcacaaaagtttgaaagcctttgaaccccctttgaccatggaaaggaagagggattctgtacaggaaatggttaactcagcaggcctgggttgctcaaaccgtgcacattctcagaaagacctgctttgggactggcccttggatggtcctgggaaattagccaccaacctttggaatagtgtgcccaataagaatttttttggatgccttaggcttcagcccacatgaaaccagtttgatgactttatcctaacaatgtaatttatgtatggtgaatgcctgcttttgctttggggtggtgtgaggatctgaggtcaggtacgcaggtgccacatgcctgcatgactaacccccagtaagaaccctggacgccaagccatgggtgagcgtccgtggttggtaacatggtttctgggaaaattaatagagcccgtgagactccactagcaaagaacacctggaagctttcacctggtttctcctggactctgccccatgtaccttttattttattctgatttgaactcatatccttttgctgtaatatatcagaacagtacatctaattcagaaaagtaagcttttctgagtcctgtgaatcctagtgaatcatcaagctttagagtagtctcagggaacctggcgcagatgcagagattagacttgagacctagagaagttaagggctttctagaacatgtagctcaagcctgggcctggagtgtgatgaggtcatggacattaagctggaatgaaggtctgtaccaactcagtccttttctggtgaggcagcatggaaagacattggccttttctccatctgtgatgacagtgatccctggacgtgacttcttcaagtgtccttagtgagtttaactgggtaagagcaaaagaaatgaaatattttattcctttctcagtcccccatcaaggacatcaatagcataaaactgctataaaataacaaagcttattataaactttgcctccaaaagtggttctagcctttctgtaatctttcatatgagcttgttgttctgttgatcaatgaattcggtaatattctatttttaaaattattttaattatgatataaacaaatgagatacctcttcagagtccacatgaatggaaatgaatataaaatcagaatccaacacataaaaagaaagttcagcaaatgcaggactccagtctccactgcttcacagtagggtttgtccttgtgttttcttgttttgtttgggaaaataatgcaaaagagatttgttgtaaaagctttgaaatttaattatgatcagggagttctaaaggaaattaaacatagcatgagtacttttaaaaaatatgaatttaatatagcatcttatcaaataattcatcccacacggctagctcacttcccaccaggaaatagaaaagaatttttgaggactcttaactaataataatttctgaatttctctgacaccttcactgtttctaaacattttttttggtcatgttaacttacttgattcttcagagtttgcttattatagccatcactttctaatagtacatagtttgaaaagcacttggccgtcttctgcattctgggaacatgtggcttcctgacccacagaggatggcttctcgctgtgtcctcatgtggtggaaggggtgaggggtctctctgaagtgtctctgctaagggcgctagtcccattcttgtgggctttattctcaccacctaatcactcccaaagtccacctcctaacaccatcgcttcaggggaaaaatttcaaagtatgaatttggggagggggcggcattaaatagtcgatgccactccccatgctttcttttcctctgttgtggttttcagatgaacagagacttctggagttgatttgctgtcttatttgttctccctgcttgttctcgctcatctgggcaggtggtttgtcccttcttccccttatccaaatgataaattcctctccctcctctcctttcctcttccagtatcttccttcagctcctcctcttaggagctcaggaaatctgtctgcacctatcatactgacagcatgagcccaaatgtttttccgtagttcatcctggatcccggaaacatgggtggctgcctgcctgccagcctcagtttatttcccagccttactggtttgtaagctttaattttagaaaagaggacagagccatgcagtccacagaccactgcatggtgcttcgtcaccaccggccggtgctcccatgggctgcccaggtgcccaggcgtcctgggtccccaccctcgcatggctgtggagccgggacagctatgacatttgtgtggggttcttaaaaatgtgagaagctcctaatatgttgttgttaaactcatcctctctgatagaatttaattttaaacacaattcccccgaatacaccctaatgtgcttgtttcatttctggagactgtatgcatcactttccttgtctggccaaggccacaacagcgtttgcgttagccactgtgtccctgagtagatggggccctgtttactcttggcctgctccgtgggatcccagcccggccctactggacctcccagctcttttacaagtaacgccttctttcccaggtagccccattttctcctccttcatgacacgcctgtgggtccctgctttcctgggactgtcatcgatgtgcacgctggtgcctatgcacatgctccccctgcatcctcctcggtggggctgacacgcagggacttgcccacatcttctcatcttgatagaaaggatccctgtggcaagccctcttcctttcttcacaaagctgcgttcctcctttcccctctcctttggatatctgccctgaagaagctgatagaagcagatactgcttctggtaggccccgctctgcctgctccgatctttcacttctgcccactccatgctatggccttctctgtctcttcccttgttaactccctcgtctgcatccaattcctgatgcctctgacccctgacactgtgtgctgcccgcagccagaggaaaccacgttctggagtttggcagacctgaaatgcccacaactctggccttacttatgggaggcccttttcttcctcttccaagctctgagcagctccgaccacaccatcctcacactgccacctcccctctgtcctcgaggcccacagtcctgcaggtgcctctgagagtccggcacggtggggagtccacagggctactgtcacacccatactaacctagggagcctgtctctgaaacactgccacatacttgttttctcccatgttccatgtttccgatttaaatgagagacatgaccatttctatctggctctatgtccatgtcttccttgagacagtgcagtggtggattagaaattgtcttatgtcagctgggcacagtggctcacacctgtaatcccagcactttgggaggctgaggcgggtggatcacgaggtcaggagatcgagaccatcctggctaacatggtgaaaccccgtctctactaaaaatacaaaaaaaatagctgggcgcggtggcgggcgcctgtagtcccagctacttgggaggctgaagcaggagcatggcgtgaacctgggaggcagagcttgcagtgagctgagatcgcaccactgtactccagcctgggtgactgagcgagactccatctcaaacaaaaaaagaaagaaattgccttatgtcaaaaattagcaattttatgctgggcatggtggctcacgcctgtaatcccagcactttgggaggctgaggtaggtggatcatgaggtcaggagatcgagaccatcctggctaacatggtgaaaccctgtctttactaaaaatgcaaaaaattagttgggcatggtggcgggcgcctgtagtcccagctactcgggaggctgaggcaggagaatggcgtgaacccgggaggcagagcttgcagtgagctgagatcacgccactacactccaacctgggtgacagagcgaaactccatctcaaaaaaaaaaagtaaagaaaaaagaaaaaaagaaaaaaattgccttatgtcaaaaattagcaattttaggccaggcacggtggctcacgcctgtaatcccagcactttgggaagctgaggggggcagatcacttgaggccaggtgtttgaaaccagcctgggcaacatggcaaaaccccatctctactaaaaatacaagaattagccaggcgtggcggcgcacacctgtagttccaagtactcaggagattgcagtgggaggatcactccagctcaagaggttaaggctgaagtgagccatgttagcaccaccgcattccagcctgagtgacagagcaagaccctgtctaaaagaaattaaataagtagcaattttggcccctggctatttctctgcccctgacctatgtttttctgaaatgttatagacatcttccaaactgatttcacctaaatatcagaaatcgctcatcatggttcctttgtccagtgctgtggaaggccccagaggaggcttctgtggggtggtgagggcaccaggtgtgagttgggacctgagacctggtccttgttcttacagccgtgatgctgatgattaggaggccctcccagagcctccagacaggcttacaccatctggagcatgggcctgggtgaggcctcgtgagctcctgcatcataacggtgcttcctgctgctccaaagctgtggaatgtgtggtctgggaacagccctggctgaggtgagcgcatctttgcttgccttccacgtgacagacctggacctcagttcttgggaaggcgtccacgttcctttcccagcttccccattggatctgacgctctcctcttgtgatacctttacctgaattgctgggagattcagcgtctggacttccccactcccagccataggaaaaccttccccccagaagtccctggtgaccactcacacagcctgatctgctgccaacatctaccccttctggaagcagctgtcactgtttccagcgtgccagcctgacatatttcagagtgtctgcatgtctctgagctattaatacacaaaataacgtaagccccctcttctggactccccagtgtgtctgagaatgcctagtaagcatccatctggttacttttagctctaaacgttggttactagctcagcccaccaagagctcacatgcccaagctctccctggttgtcttatcctccctggctattacctctccctggctattatctcttactgaccattatcccccagggcgaatacaatcccttcttcttcacactgaaagccaccactaacacaatgatgatgtgtgtttaatgagtttcacccgctgaagttttagataaactatttttttaattctaatcttgcaaacaaggcttctgtgttcctctggtttctgggtcttcctcatgccaagaggccctccctaacaccttagccccagacctcttctgtcatctcagactctaaagcaaggtttcttaacgtggggtcccaggggcctgtgaacttaaagaaacaaaaaggtcataattatttttattaaagtctcactaaaaaactgctgcccttcagcatgtctgtaggcaaaatacacagtagttttggcattacctgtgactaaaaaaaatcacagatattcccatatcacagtggcaattgcagatatcttgaaatacaacatactctcaccattatttcaaagtcatagtaggttttaggcatacccctatttgataagctttgagactctaggcagacactcaagcaacagagctggtcagtctctggagattcccttctcaagagtcattcaggggcacgacctaaaggaacgagctttagagtgcagtttaactcaacagcctttggagaatctagcatttctggagtccaggctgtcttttccttacaaagtaaattatcaaatttgcattgtttatcattgggtatccttgctaaacaggagtctcattcttttttccttttttttgttttttttttttttttgggggacggggtctcgctctgtcacccaggctggagcgcagtggcacaatctcggctcactgcaagctctgcctcctggcttcatgccattctcctgcctcagcctcccgagtagctgggactacaggtgcccgccatcacacccgcctattttttttttttttttgtatttttagtagagacggggtttcaccgtgttagccaggatggatggtctcgatctcctgaccttgtgatcctcccgcctcagcctcccaaagtgctgggattacaggcatgagcaggagtcccattcttataagcatcagaattaaaaactcaaaattggatatctgatttgacaggcaagtcaagggagtgagctaggcagataactgggacaaggacgttgcaggtggaggtcagctggcataaacaacctgaagcaccgagtgttgctgagaaagagcaaggaagcctgtgtggctggggcctgaatgaaggaatgggaaggaaattagcttagagaggtagcaaagcgtatttatccttgtataccgttgggagcactgattttattttatttaaagcatgccttcttgtccaagacaattccccagtaaaatgttactagtttatctaagcccagacagccatttccctgatgtatctttaaaaataaaaaatctaactcctgtgttttaaatacattgtgaatcattaataaagcaatataaatacattttatttttgtatatttataactatgtttcaaaataatgcattttctttgcaatctgacatattttatcttatatatttaaacagaagattctgacaaatgaaatgctggcatcaccagattgttctaggagttcattttttttctgtctcatttttgtctaaagagacaaaaaagatctagaaccttttctaaattttagggcctgaatcccctctctctttaaaatgtgtccgcaccccccaccgaccccatcccccatccccccctacccccttgttgtgtggggcaattcagccttttcaggtggctttatatacctgtgactgcctttaaaggtggctttatatacctgtggctgcctttgaaggtggctttatatacctgtggctgcctttgaaggtggctttatacacctgtagctctggggccttccaagctaagcaacagtactgctaaacagttaagtctacatagttcctgggtggtaagtgatttccctgtattatttcacaaaatcataaaagcatttatttgcccagtaccccacaagtgatagaatctgagtccagaggttcggccaccagggctccagggcctgaggttttactgtgttgtgtgctgtggatgggttactatatcctttgacataaatatatacatacttggcttatgtctgctttgtccccagaatgcacacatatctgtggttaagacagtgttccttctttctttctctctcttttcctttctttgcccctctgcactggcattgaactctggggagaagacacttgcgttctgaggctgtttctctgtctctaaatgaagacagtcaaactgaatcgtttccaagtccccgtccagcatttaaattcagtgtaagaaggaactcctggctacgctgccttcctaacctggtcaaggaatgttcattctttgtattgactgcagtgtcattgaatttgctgcaaggctttacatcctcctcatgaagaggtgaccttgtatctagagtcccttcgtctctgtctttgatgcagtgatatttctcattgtgagtgattccataagctagaccagcagttgcccatattccatggttgattagttttctagaaaagaagaggacccttcacaatcacagttcttgtttggaaacccaacaggaccttaacatgtattcaaagtgctgataccaaatgcctcttcttacttggtgcccactcctctgcacacaagaacaagtgtttttttcttacaaataaccacttttcagttcattctagtatcacatggtttctagacttctttgcaatttgagtggaactaaactacagttcattgacaggcatcacacagcacgtgtttatagagattaacagaatatctctgccctggtgacattggtagaaggctcattgagatgattttactgtgaacgacgtgaatgccactattctagtaatagtgttcacagctgtatcaatttatggcttattaagtgtagggccaactaaataacacatatttttctacacaactgttgtcaagctgaatttgttccttctaggaaatagtacaacctaatttttcatctaaagatagaggtatacctggtcaaatccttcatagcaagaaagatactactgctagtatgaatcttgacttagaagatgaaagaagctcaaatgttcagttgttccaatcctttgaatttatagctgagggaatggaagtccatcaggagggcatgaagcctgttcaagttcacacagaggatgtggagcctctgatgctcatcgctgtggatccttcccatgcctttatcccccctctgcacacctcacatagtgtcatgagttcctgttctagagctgtggtcccctgaagcaaatctacgggtctcccttctcctgtcttttccttcctttgtgtgtgtgtatgtgcgtgtatgtttgagatcaatgatttctcttttgcctacttttgacttaagataacatttgttttggagctcgacaagcatgactcagcagtgtaacactctttttaattttaattattattattttatggttattcttttgtgattatcaagttgttcttgatgatatctgggcactgtgcaagacttccttcactgcatgggagtatgtgaggttcatttcaattgcacttgtgtttccatcttcttcccttctatcactgactcactcaaagcttgcttttgtttcataaaggatcaaccaacagaaaattgagaaagtcagtccattaatttgtttggccagttttagtcattggttggattcaaaataccccatctattcaacccagatggaaagaactgaccttttctgaagctaaaacatatgcaaaatggacaaagcccatggcttgacctgacctattcctaggtcatggtatcctgatagagcattctccccatccgaccctgaggcacctgaacccagcaacctctttatgcactcacattttcagccttaagggtcttccctaagctccgctttctgagggtaaagcctttaactttcctttgtggacaaattgctcactagctcatcattggggttcagtggacaaggtatccttacatgccatctcttcatgagggcgtgaaggctccgttcgtaaagaactatgatgtggtcatgtaatgggttcactttaagacttgaaaataagtaaagcgaataagttacactataattcatcatctttcatatatagcagtaatgcaataatacaataattactttggtttttgttggtaaattatataaatcattctattcattagagataatgaaaaagtaacacaaacatgatgtgatgtctcccttatgctactgatttactttatttcagtcccgcctcacttcagaatgcaattttttccttgcaggaattacttgtaatggcagtggtagaaccaggggatcaagatatccagcttctgatgcaggaaatccatctctctttattgatagcccagcatcatgcttttatctagagaggcatttatccatctaaacacccctagaaaagctatgtggaaaatgtaaaagcatcaggaagctcaaagttacagccaaggcacagactgaatgctttaaaatcttgtctcatccacagaaatccacaaagattatttccatagatcaaggacatagtaatgctgtttgccctttttacatagtagtaccgtatatttattagctctattgatgaaaataggagagcaactctccttgatattagagaccttggcaaacgtaaagtacttaaaaaatgaatagactgccttccgaatgtgaactcactgactaagcccagtgaaaggagagtatggcatgaaatcagagaatgatgaatggccaggattacgcgcgcgcgcttgtgtgtgtgtgtgtgtgtgtgtgtgtatgtgaaaataaacaatatgattagtgtttattctttttaacaatccacaaattgcctgcttttctctacttttttttttgagatcaagcctcactctgttacccaggctggagtacagtgggtgtgatctcagtgtactgcaacctccgcctcacaggttcaaatgattctcctgcctcagccttgccagtagctgggattacaggtgcccaccaccacgcctggctaatatttatatttttagcggggggttgggggcggggggattcaccatgttggccaggctggtctcgaactcctgacttcaggtgatccgcccacctcagcctcccaaagtgctgggattacaggcatgagccaccttgtctggcctctactttctccagttagaaagtggaagaaactgagcttcaaatgtcttgcttacagctattttggggctctgagttgagatttttgttgtaccatttgtgaagccatccaggtgctgggtctaatcattcctgggcaactgagatacagaaggagccccagctcagatggtgcacgggcacatcataccctgggcattatttttgccctttttctggaagtacgattggaaatgggcagcagatggaccacttcgcattttacccgttcaagcaaggggtatttttcttctaggaagtgggatttccaagcaaaactgccgctttggtagtcacttgccatacttcagtgtccatggaaaaacaactgcgtataggaagagggaagggggacatagcgtgccaactctaactctgatgtctgcaccactcatccataatccatgtcccagtggggaaggtgatattccctggcatctacagacccagcaggcacacggtgggtgagtgggcctggtcacctgcaaccgcagtagaaactctatcccaaggcaaaaggaaattaagaaatccatttgtgaataatattcacaactacaatactgttttgttggatctttcttagtttcttcagttcaaggttgatttgtggcccatgagtctctgatccagacatttgaaaatctctagactcagtgaaagtcatgttaattataaaatcagtaagtacactatacaagagcagctttgagcttggtaggaagacggccttcccaggaaccagagaggagagagccagctttgaccctgcgaggcacatgggagaaaagagttcagttggtttatattctatgaatttactttccccattggtattccgaagtgttcactgaaacacagctgctcctggcactctaatagacatttcccaggacctcatggcagccttatccacagtctccagcctgcagtcacatgtatttttcaggggttcactgttagccctttgagcaaatatttatagagttgtttttaaaaaattactgatgctgtaattaaaaagaacacttaatccaaattacttaatagacgaataaatgagtgaataatcaaaacatttaataccactggtatatataagaaatgaattaatttcaaagtgtggaaaaattatgtgggcttcttatcagtggtattaatctatttttgatacataaaccaccctaagaggttttcctatctatcccaagtgtcattttgcagtattagtttctctaggatgtgttttcattagcctcttagatataaatggctataccactaaaatgtaggaaaaatcccaaatgaaagccctttccctattcaccctgttaagcttcctcttgatggaagctctcttcacccttgaaagctgctaggaggtaatggagggcactgtggccacccagccctggtgcactgagtacctttccttaataaatcaccgttggagtcctatggcaacaacctaacttgataacacatatatctagatgtcttgcttcattgatatgacagtgatttctcttttcatactcaccttgggaatctaagatgttagaagctaataaatcccccacacataaaacatataatgatacattcagagaaagattctctaaactgatttcagcagttcttacatataatagaaacacagacttgcctaccatgattttgttacttttgttgtcatagcctcattcattagtttgacaaatacttgttgcccatctcgagtgttccaggcaccgtgacaaacactggttatgaacagcaaaggagatggaagtagtccctcctctcaaggagtctgtcctctactggggagatacagggaggtatccagcagtacagcctgtctgtctggaaggagcccaccccacatgcagttgaaaaacacagcatggcagatttttcaattttaaaaaaaaatcacgtgctgattttataacagattttaaatatgacctaccagtagattatagttcatcatttttgaaaggcactgttgttaacgatgtagcaccttcccgtcactggtatctcagtagccaccagtcagagcagctcctagcagactccagaatcatgttaatatcttccatccgatcacctctctgaagactgtttgtagataagtgtgtcttaagtgaactttattcgaatgaactcctaccctgtagatgacagtttttgcatgaaccgtaatcagacatagatcttcttagggaacatataatggggaaaataggacttggccagtcatggcagatgttcattgatgtgtgtcatatgaatagatggatgaatagcacaaggtaaagagtggtgtgttttataaggcaggcacatgcagatgttatgaggacttggcaaggctagtagtaactccttaaagaatcatggaagacctcaaaagccaggaggtggtgtgtgagctgggctttaaagtaagcctatggttgtgccatctggaaatttaatttcacaacatcctggaatgtgtttccagtgaatgagtcaatgaaatgacagaagtcagtggacaaagattactgggaattttcctgcaagatgcagcactcagacctgggtttgaacccaaactctctcctacttttaccccaggacttttcccttataagacaatgcatgtgaaacgtatggttataaagctaccccaaagtagaatcttttattattcttcagtaaaacccttcatgggatgagagtttacgaataaattcagagttcatctggaggtgcccggtggatctcttgatgtcctagcttcccaggtacattgccagtttacaggaaaatatgcctttttgaaactgattgaaaacaaattagctgggttttcttggacgatgaatctgtagtttttcaaagatcagaaaattcctgttctccaagaagacaggtgcagaagtgatcatctgaggctgctctccaaggtcctcagtgtatttgcaatttcctcagagtctgtcagccatcacagcatagcctctttcttttttctggatttcttttttattccatgataggtggaataaggcaatctgggcccagtaatgcttgttttttaactcagtgtcatcactatctctcagccagtgttgtgtcccacccaccaatggcccagtgaaaagtgatccagaatcccttctgaatcactgaattatttgcacacaaactcatctatctgatctgtccatcctccatgataaacggaaattagtttcattttctgccctccccttcctcctggaatatctgactcttcaataaatgagaagacagagttatggttcatttactgacttgattttaatatttcggagagcatttaaaacatttatagcgcagcagtcttccttttcataggaaacaaaagtcttctaaaaggcagtctcatttcccgtgtggttagttgaatacagaaaccgtgtagtcagaaggaaggggctgccctgagtcagcccgggctcccggggctggacggagcttgcatttctgagctcccagggcgcccccaagtggcgatgtcaagctccaagttgttctcagtgtgctcaacagcagcgcttttataaggttctttttgttttgttttgctttggctttgctgttgtttgttcggctgcttttatttttgcagttggctgaattcatccgagggttatacaaatcaaaaactgtaagtggagaggatctaccagttgttttgcaaagatagaggtgctatcacggaggatgctgttggtgtggcataggtgggaaagagaagcagtaagaagaaaggagaataaaagagaaatccatgaagctgtaagaagtgtttttttgtcactttttaatgctgatttattcacctggatcaaaataaggaaaaacacacgaggtctaaatcatcaaaataagttgcaagataaggcagcacgcttcatgaggctgtttctcttgctttctgttctcaacaccagttctgtgtaagatgacctgcaacatagactctgcatgtagaatctgttagtggctgacccctgccttatataaacaaggctggtaaatatggagcgaggctcacattcaaacaacaattctatgggctggattaagactcaaagtccctaaacactcatcaaatcatgttgcctctcccatatgcaattccagaaggataatttattttgttaactaataaaagcaatatcatgtgtgctgaaagtattttttcccacatattctgtgtacagaattctatatatgttcctaggggctggaacatttttcctttaactgtgattcttattctgattactagtgttctgaatgcacacttagcctgcgtgctacatggcctgtgcagctctttcctcctgccccgggaagaggatttcaagcctgtcatcttcaactcatagcagccttggtggagtgggttccaaactggctcttatgatgccagctcaaagtcagcctcttgggagtctctttagggcaacagggttttgcctttcaacacaacttaagtataaagtgcagataaacataagagtgttattttaaaataaatttgctaaagcattatttctcttttcccctctccctcctcctctgtccttcctctaccctcctctttcagactcatactcctcctctgtggctttacaaatcctggatagaaaacatctcacaaaacatgttctcttctcttcacatatttaagaggccttcgagcattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatgtgttttaaaggttaggtacataaaagaagttttgaggtttcccctctgtaacaactgattggccctctcgggaactctgtgcttaaataaagctgataggattggcctctcttagcatgcttatgccatagatgagcgtctgatgcttagcgacctatcctggtgcaagagccaggcagtggaagaaccaggtgtgcagtgtgtccaacaggaatgcttttggctgtgaaacaattcctggctgaaagggcctaagcccgggggattttatctgggtgggaagaggattctggttttagttcagtacctgcatgctatcagggctcaaggtgtgcatccttgcaaacactggccccttcttctcatgtttgttttttttgttgtttgtttgtttgagacagagtctgtctctgtggccaggctggagtgcagtgagtggtgaaatcctggctcactgcaacctctgactccctggttcaagtgattctcctgcctcagcctcgcgagtagctaggattacagtcatacgccaccaggtccagctaatttttgtatttttagtagagccggggtttcaccatgttggccaggatggtctcgatttcccgacctcgtgatccgcccacctcggcctcccaaagtgctgagattacaggcgtgagccacggcgcctggcctcttctcatggtttcaaaaaggctacagcagctttgagcatcaaatcctcacacaactatgttcaaagacagaaaacaggaggaagtgatgttggcaggccaggggaggggtccctcctctgaccactctctcttaccagagagaaaaataatctttgccacagcctcccagaaaactttttatttctgcttcatcaagcggacacccttaacttgtggatattctatattggcaggtaaataagtgagaagggatatgggtgcagcacgggggcaaccaatgaaaggttggccatacaagcaggtgttccaataagacagaagaatacatgaaccatgctcacaggaaaatttatatagtttcctcttggaaaacaacaacaaaaaccttctggtcttatccaaagcattaattggatgaaaaatgtcaagcttttctcagtgttcggtgcagtacaaacgtaggattatttctaagtggaggagcaatagaagatagcactgtagaactcttccgtcatgccaagagaagttagatatgaccaatacgatgaagggaaatgataaggtgacattatccctgagctaaaagtcaccgaatctgtgacaaggtatgggctagtcaacttgtggagctctccagcccccttctcaatgaagattttaaggcaaactagaattgcattacatttagtgattatttttcctcaaagaccaacgacttcaatgggagatagaagagtctgtggatcacttgcttttattctcttcctatagctgtgaaaattgattcaagaaattgccaacattccactttaatcagggtagaaaccaagagttgggtgtagtttatccattgagatgctctatgcattggcaatgccatcatttaaaaacatcatggagactgtttttagtcatatggacaaatccaagcaggctgccttcccaggaaatcaggagcaacctatgaagttctaggcttgaagttttttgattggtggacttaataaaatgtagatataatcagtagattaaaagtgagtactggctgggcacggtggctcacgtctgtaatcccagcactttgggaggccaaggtgggcgaatcatctgaggtcaggggtttgagaccaacctgaccaacatcgtgaaaccccgtctctaccccagctaaaaatacaaaattagccagctctggtggcgcatgcctgtaattctagctacttgggagtctgaggcaggagaatcacttgaaccgggcaggtggagtttgcagtgagctgagatcatgccattgcactccagcctgggtaaaaagaatgaaactccatctcaaaaaaaaaaaaaaaaaaaaaaaaaaaaaaaaaaaaaaaaaaaaggacctattccaagattttcattaaatgctcagataagtataccacccgaggatcagtattataaccaggtatcttattggaagtcttgtgttttatcttggaatactcatgagttcggtattccatctcctggtatatttggattggataattttatgttatttgataaaattgcctactcaaggaagatagttatcctagggatttgaatatctcaattgggaaactcagcattcattgagaccacaatcaaccatttacatctcattttgagttggacttgaagttgtggatgatatcagagccctgagagagagaaatttaaaaaggaatcctgaaaggcagatgtaaatatcgccttacactgcttcttcttttaccccaagatggctaagaaagccttcaaagtcctttgaaagcattaatttatccaacttttcccacaaagactgaaatgggtctgcatcaatgatgtaatttgggtattgctgggttatacaggagcacaatggtgatgattatgggtgcgctgcagaggactgagttaatggaatcccatcagggactcagagcacaaattcggggcacaaacaggacccacctcatcccgctgcagctgagagtcactgttgttgctgctgtgagtgagggaaaaggctgatcaaattgcaggctcatgtgactggtggatttatttagccaatgggcaatttcggtgtacctctcaagcaaaatataagtaattgttgagagaattacttttttgattaccaaattactatgatttgaaatgcaattagtagtatagacaaacctatttttcccctttatgagaaggaaattgttcggaaatgggtatagtggtgctgataaagttacagtccacagtgaattaaattacccacaagaagcagatacatggtttcatttcagttttattgctcctaatgcaatttgttttcattaatgagaacccacatgtatgcatgaatcagggttttgcactgatacctcctgtgtggggtatttctttttccaggttaggtttcattctccatatttaagatctattgtgtgtatattgatatttgcctataaatattaaagatgcacctgtggttcagagaatatgttaaaattcaagaaaagctaccgatctacctaaagtagcatcaactcgttttttaaatttgtagatatttccatttgtacatggaaatttagagggaatcttaagtgacggtgaaaaataaaatggattttataatgaaccctttaacatgcttgaaaggagtggattcaggagaattaagttcatgaaagtcaggtttgaactttaaatgtttattaactttattgatttttaattaaggacaggatttttttattgcattgaaaaagcaatgagtccaaactagaggcacggaagattttttttatgaaatcagtgtttgaaagtaaggcttttttttctttgcagttctgcagagttcttctgccaaattgcatatgttctggcaagatgggaaaaggctctctgctaaggtacaaaatcagagtatctcagataagccacaacagttgtggtatgatagtttgaccatatctttgcctttgctttgacaattcccttttgatttctaccttcttcctgacatgaaacttaaacatcagttcaagggcgaaacagcatctgaaaatgtcctgcaaagactaaatggactgcattcttttttgattctgaataaagtcttagaaaagataaaaaaaaaaaaaacactccctccctcatttaaatggtttcttttttttattcttgaaaaatccttacccttaggagaatccttgtccaatcctttaaatgtataagctgttatctgagacctgagcaaacatttgagaaatcttccaggtcaccttggtgccgtgaagaaaattgctctagtacattgctctagtgcagtggttctcagacttgtgcatgcatcagaatcatctggagagcttgttaaatgcagcttgcccggccccagccctgagtttcagctggtctgagacagggcccacgaatctgcatttccaacaagtccctgaatgatgctttcgctgttggtccagaaacaactctttgaaagccactgtatgagtagattaaaaatgctacttggtgctgctataataaataaatcacagctttattgtgaacacatttgcaagctagtggtttctaacagtccttttgtagtaagactagcagtgctccaaatgtaccaaaaggagcaagaaattgagaaaacggcatctattcacaaaagtaaagcattatcagtcggataatttgtagtatcagtcttgcttcactttgaggagtactgatgatcatctgcatgaaagcaagttcactgtagttcatgatttcatccttagaacgtagcgcaatgaatggcacatagtcagtgctcaggtgttaactgaataagtgaaatgcctacaagaagcatggacttgaccatgccattttttcatgcattgatttggctttaatgacacaagcatgctgtttaaccaattatcctcagtgacttacccaacaagtatttatttcaagacccacatttctgctggttaactgtgattcagctggtctacactgggctcggctaagagactctgctttgtgctccccaattatctggcttagccccaggctgtgggttgtattgaggtcttctccaagtgtgtttgttctggggccaggctaaagcatcggctgttaatagggacatgtttttgtatggtggatcatcagagtgcagaagccagctagggtatgcaagcagctgcaaggcctctgcctgcatcatgtccacgcacatcccattagtccaagtaagtcacatgaccagtctcaaagtcagggtggcagtaggtgtcaggggacaggttaagatgcttccctgcagggggcatggggtggagagtagtatttgctgaacaacattccagtctgttacagtttacaatatggcaataatggcttattccatttagaactcaaagatgagtgttcaggagctggatatttataggttggaaatgcaatcacatgctccgctatattatgctcttgaaagaagatgctgctactcagactgtcccactgaacatctgaaaagggggtttgtcacgtaaaggaagactctttcctcttccctccttatgtttcacagtcattgtgttgttggaagaagagatggaaagatacactggaatctgcagtacttggacctgggggccaacttgctgggcttttcttattttgttatttctggccgacaagccttctctttcgggggtgaattaagttgtgctcacactcaaccctccctaaatcttagtccagatgcacattttagaaatacactatacccccttcctttatttgtaactgcagtaatttttagtgaagtcaagttttccactctctgtaactgtttctattagcctgcaggagagtaccaatttacgtggcaggatttattgagttgacactggctctgtttgttttgctgtcaggaaaagacgttgcatttgactgaccctatctttatccattttggttttgctgttgctttgaagtcaaagcctgagaatgcctctgggctgatgccaatgtccccagaagacagtgtaagcccttgttccctgtggctcacagtcagttctaaggctgaccataccgcaagcaggacttggtccttcacaaggcatgccagtggtcagcagagagaacagacacaagctttctcttctttctgaatgcaaccatcacctctcctggttacaaaattaaagcactgaagtgcagagactcattcctatcactttaacattgaagggaatcatatttaacttaattcacctgaccctaagaagtgtgtggtttgaaaagggcaaggcgctctaggggcactttggagcagaagtcatatctcgtttaatctaatacagtttgatctatgaactaagacgttttggagaacaacatggttatggtcaaatgatcaccagggacaaacagaaagagaagagagtcttctataccccatgctccaaaaacctaagagccttgggaagcactgtggaaacgatcattgtgtcaccagaaaataggaaatgacaggagttcgtgcctcctccagggtgagaggtgattatttggataatttctgaggcaatgttggtagcacaaggcaagatttgataaatattcagagggcagcaaggaagttttagagaaaataatatatattctacgtatagcctacagatattgatccagagaagggacatgcatgaaggcaagacaacagaagtgaagaaaggtagttagaaagtgggaggagaagagtcgattatggttcaatgtagaaaggcaagatgaagaactaggggagaatcctagaggaaggtggtaaggttgtgagcagccctccgaggggccacagagaaaacatgggatgaggttggcaccagccatttgcgtaggatcaaaagcttgtgcagctcacctggcgataaaccttaacactcgtgttaatcaaccactgtgtttgtgtacatgacactagtgtagttagttgtacgtatgttttgaactgtgtaagatccaagcagtgacacaatggtagggctaaaatgcagagacatgtgctattgggagattgaagcttaactttactgatgttagagaaaggctatttattgggttacaacaaatgattttacataaaacataatttttaagtattaagttgaaaagcccaaattgacccaattcatactttaactctgtttttcaaaagcctgaaatagcaattattgtgtgtgtgtgtatgtgtgtgtgtcctggatatttcctgtttgaaggtgtgtaaaaggtcttactacccagcccctagtggagagttctcttgcaaaaaacaaaaacggaaacaagaaaccaaacatgctttgagagatagagagtgagaaacagattttcagagtggagaatatgccttctatttatgcatttagcattgtgttttctcaagctacccagattttttaaaatttctccccgtttatgagttcaagctgataatatgtaaaagacagtgatgcccactgttttagggaagaccttccttcagagtatgctaacttagccatttcatttcttcaaatattagtatttggaaaagaaaaaacagtcttaaatatggttctgtcctccctcagcacccagagaaaagggaagtcaactacaggatataattctctcagaaataagaaaacctcttagctaataaaaatcatgcttaggctgctaaactcaatggatgtacttttgttattcctacaatgcttagcttgcaggtagaccaaaaatttgccttcattgtcattttaaaaatgactatccaacatattttgcagcatctgcctaatcccaatgacttatatttgttttgtaaatttgttctagggaaaataaacacacacccacacctttgtaataaatagggaagcactaatcatatgaaactagatagaaaaatgggttgggggcatttggtttggagcagcatggaagaattaaactcgacattaaataatttgcaaaatattttcaaaaatattttctcacacttacccaataagtaggaataaaaatctgcttcatcgccacagtgtacttcaggcgttcaaggagaaattgagtagagggaaatattgacatgtttccttccgaaccactacacctattttgaaatgcccattgggtacttttgctcctcttcggggtatctttttccttgtttgtgtgtgtgtgtgtgtgtgtgtggataaggggaggtgaaaggtgattagagacaagaattgaattaattatacatcataaacataacatgccatagcttgccagtctttaaaattgtatcacttcacttattctaacatactaaccactttatttttttatatgtgggaccacagtgtcctcacaccctcgactgcaatgtgtgtatccgtgcttaacacaaatttggatgtgtgggtgcataaacgtgcatgcacatacacacgaggtatagaacatttatttatttatttatttatttagagatggagtcgtgctctgtcgccaggctagaatgcagtggcgcgatctcggctcattgcaacctccgcctcccgggttcaagcaattctcctgtctcagcctcctgagtagctgggactacaggcgccaccatcacacctggctaatttttgtatttttagtggagatggggtttcaccatgttggccaggatggtctcaatctcctcacctcgtgatccacccgcttctgcctcccaaagtgctgggattacaggcgtgagccaccgcgcccggccagaacattctttaaaatgtccctagaagcaccgcgttcagtgtgcaaggtgcaagagtatagccaagcgcttttcaatttgggtaaagggcgctccatctggatcatccttgaggaacatcctcgtgttcatccatgctgtttccagtcctccccagcattccggctcctttcacacctgcatctttcagacgctcgctctttcctgccctccgtttcttctgcttaattgtgagatttgcttcccagcacaaatttttacttcaactctttcccctgttgcttatgagttttatggtgatttcattttataattttaagcagaaatcgcttatcatattttcttagataatttaattgagattttaaactttagttagattacagttacctacaatgccttgagaatatagtttttaaaagtggcacatatgctttatcccaatagtattctatctatgattaatatgcacacatctatcattgtattttgtataaactatattagtatgacatttagtttgtgtaaaaatatgcatgcatatttcatagatagcgtatgtatattacataagtgggaccctaactgcatctatatttagtgaaatgtcaggatcgcgatgctgcggtgaatagcatgagctttctttcatgtccatgttaggagaggcagcttcctcccatcaaaagcacagctggggcagaggagggggttgagagcaaggttttctatctatctaattgtggtgacttttaaagtttagttttatggctctgttgcctctgtcttcaaagtcaaatggagcagctgaagctctccccaccccagacccacctgcctggcctctcccatgcagcaagtttcgcttagctgttgcaatcctggttttacttggttttgtatttgctattttttaaagtgtttttaaactcatgtttcttcatagtaaagggtaactactgtggagtaaacagaagatgagcgtggtacaaattttggttaaaccaaaaactacacactggattgaaagcttggggaagggaggcaggtggaagggactgaaggaggtctcttcccaggagacttgttcaccggcatccagtattctcccccgcagttagggaaacagagggagcatgcagtttcaggcccaggcaggcctctctctgggcttggggcaatgccagggctgggggcgagcctgcagtcagccttgtgagtggcagccgaggctgttattttgaaaccctaagtggaaacaggcatggaaacccggaaggagcagggagccttaggcagtcctgggagatgaagccaacgccctacctccatgtggaaggaggcggcggaatgggcagggtcgggtctcacaggttcccccctctggagttggggtttcccggcccacgttcactctctggatgtgataggtccttcccggccgggaagggctggaaggggcgcgcaaggaggacgtggggacgagacgagagagacgcgtgcccagcaactccagaaggacggagaggagtgcagaagggagccggggaggacgcgggagggccgggaggggaagagaagccaggccgggcctggagcggaggagcggagcccgctggtgcgggtgtccacacaggggcgctggagcgcgccttcctgcggctgggcaggaggcaagcccgagagcgcgcggcgagtggagccatgtcgccctccctcgctctcggcgggcacagtgaggcgcaggctttggaaaagttgcgggcagccggagagccgagcctccgcctgcgttcatgataatgagaatggagtcgcggtcacagccgggctctctgcggggcgcatcgcccgcgaggggcgcctgggcctctgggcgtcctctgccgccccgcgacctttcctgccctcctccggagagaggcgaagggaaggggcggtttcggagggagctgggctgtggagggagggcggcctcttcaccagcgtcgtccgaccaccccgcgccctcctggtggctctcccacgccccattcgcaccccaggtcctcggggtgtctctggtgttgcttcaagttaggcaagaggagctgggggcgcggggagcccggcgccgcagcgcgtgcgtggctggggcgccccggggccggctgcaccttcagtcgccccctggccggcctgcctgcctcgacctccgcatccccttgcaccgtccgctcgcgtgctgcggggcactcgcagcactaccttcggtggggccgcagcaccctgagctcccgggactcccccaccgcccccgcacccacgacccgcgtggtcccagcccctccaccctcttcacgcaccctcgcacccttttgtgcgaccccgtgccctctccgggctgccaacccctgccacccaggtgccagtcccgggcgcggggaggaggccggtggggaagggggcggaggggccggggtggaggaggagctgcgcgaggggcctgggggcggggagcgaggagagcgctcggaatgtgtgccggtctctaggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgagaaaaagtctaaatctttcaactgtctatttgatcccattactctcatcaccaataggaccagtgcttggtgtactcacctacagaatagctatggatattgcaggagcatggagagttgcaatgttgccctctcttgatcccagtggcccctacaaagtgggagccatgaggccaggtactgagaagtgcccagtgaatacatgctgctgctgttactaataatattactgtttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcgaggcggggactgagagccagcccctcttcccccactggcttaggacgcccatcggggatcctaagatccttaggacccacctggaggactgtgggtatgaggtgttcaagaagaaagctcaaatcttccgacggcaggtaccttgcgtgggatttacaatacgacaggggtccgaacgcagctcaggaacagaaagaaagcaggttatttgcaatctaccggagcttaagggcagaaggcaggtgagagaattcttaggagctgtggggttttgtaggctgtggatcccaaacgttgcagtattagccaagcctttgtatgaggtcacaaagggggcggggacccggaacctttgaaatggggatcccgacaacagcaagtctttcattagttataagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaagaatggcccccctatttgagggccttggcagcaactgccctgctagtacaagaagcaaataagctgattcttgggcaaaacctgaacataaaggccccccattttgtgatggctgagatccatcccctcttcccccctgactcttgggactcccattgcgggtggagggaggcatcccccatgaggcggggactcagagccaacccctcttcccccccctggctcttgggaccaccatcgcagggggggaggcaatccccgcgaggcggggactgcgaacctccccctttcctcccctggctctttgcacccccatcgcagggggggaggcacccctcgtgatgcggggactgagagcgagcccctcttcccccctttgctcttaggatccccatcgctgggggcggaggcaccccccgcgaggcagggactgagagccagtccctcttccccccctggctctgaggacccccatcgcaggagggggaggcaaccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggacgcaccccccgcgaggcggggactgagagccagaccctcttccccccccagcttaggacccacatcgttgatcctaagatccttaggacccacctggaggactgcgggtggtaggtgtccaagtagaaagttcaaatcttccgacggcaggtaccttacgtgggattactgagagccagtccctcttcccccccggctctgaggaaccccatcacaggagggggaggcaccccccacgacagtggggactgagagctatcccctcttccgcccctggctgttagtacccccatcgcaggtggggaggcaccccctacgagagtggggactgagagctatcccctcttccgcccctggctgttagtacccccatcgcagggtgggggaggcacccccccgcgaggcagggactgagagccagcctctgttcccccactggctcttaggacccccatcgcagaggggggagggaccccccacgaggcggggactgagagccagtccctcttccccctctggctcttaggaaccccatcgcaggagggtgtggcaccccccacgagggtggggactgagagctatcccctcttccgcccctggctgttaatacccccatcgcagggtgggggaggcaccccccgcgaggtagggactgagagcctgcccctgttcccccactggctcttaggacacccatcgcagaggggggaggcaccccccttgaggcggggactgagagccagaccctcttccccccctggcttagggcccccatcgttgatcctaagatccttaggacccacctggaggactgtgggtattaggtgtccaagtagaaagatcaaatcttccgacggcaggtaccttacatgggatttacgatccgacgggtccgaacgcagctcgggaacagaaagaaagcaggttatttgcaatctaccggagcttaagggcagaaggcaggtgagagaattcttaggagctgtggggttttgtagactgtggatcccaaactgcagtatgagcaaagcctttgtatgaggtcacaaagggggcggggacccggaacttttgaaatggggatcccaacaacagcaagtttttcatgagttacaagaaaatcttctgacagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgacggccttggcagcaactgccctgctagtacaagaagcaaataagctcattcttgggcaaaacctgaacataaagggcccccattttgtgatggctgagatccatcccctcttcccccctggctgttgggacccgcatcgcgggaggggaggcaccccccgcgaggcggggactcagagccaacccctcttccccccctggctcttgggaccaccatcgcagggggggaggcaatcctcccgaggcgggactgcaaacctccacctttcctcccctggctctttgcacccccatcgcagggggggaggcacccctcacgacacggggactgagagcgagcccctcttcccccctttgctcttaggatccccatcgctgggggcggaggcaccccccgcgaggcagggactgagaggcaatccctcttccccccctggctcttaggacccccatcgcaggagggggaggcaccccccgcgaggcagggactgagagccagcccctggttcccccactggctcttaggacccccatcgcagaggggggaggcaccccccgcgaggcggggactgcgagccagaccctcttccccctctggcttaggacctccatcgttgatcctaagatccttaggacccacctggaggactgcgggtgttaggtgtccaagtagaaagttcaaatcttccgacggcaggtaccttacgtgggattactgagagccagtccctcttcccccccctggctctgaggacccccatcgcaggagggggaggcaccccccacgagagtggcgactgagagctatcccctcttccgcccctggctgttagtacccccatcgcagggggggaggcaccccccgcgaggcagggactgagagccagtccctcttccccccctggctcttaggacgcccatcacaggagggggacgcaccccccatgaggcagggactgagagccagcccctgttcccccactggctcttaggacccacatcacagagtggggaggcaccccccacgaggcggggactgagagccagaccctcttcccccactggcataggacccccatcgttgatgttaagatccttaggacccacctggaggactgtgggtattaggtgtccaagtagagagttcaaatcttctgacggcaggtaccttatgtgggatttacgatccgacgggtccgaacgcagctcgggaacagaaagaaagcaggttatttgcaatctaccggaaattaagggcagaaggcaggtgagagaattcttaggagctgtggggttttgtagactgtggatcccaaactgcagtattagccaagcctttgtatgaggtcacaaagggggcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacatctctaaacaactagacagggttgctaaaggatggcccccctattagagggccttggcagcaactgccctgctagtacaagaagcaaataagctgattcttgggcaaaacctgaacataaaggccccccattttgtgatggctgagatccatcccctcttcccccctggctcttgggactcccatcacaggggggggaggcacccgctgcgaggcggggactcagagccaacccctcttccccccctggctcttgggaccaccatcgcagggggggaggcaatccccgcgaggcggggactgcgaacctccccctttcctcccctggctctttgcacccccatcgcagggagggaggcacccctcgcgacgcggggactgagagcgagcccctcttcccccctttgctcttaggatccccatcgctgggggcggaggcaccccccgcgaggcagggactgagaggcaatccctcttccccccctggctctgaggacccccatcgcaggagggggaggcaaccctgcgagggtggggactgagagctatcccctcttccgcccctggctgttggtacccccatcgcagggggggggaggcaccccccgcgaggcagggactgacagccagcccctggttcccccactggctcttaggacccccatcgcagaggggggacgcaccccccgcgaggcggggactgagagccagaccctcatcccccaccggcttaggacccacatcgttgatcctaagatccttaggacccacctggaggactgcgggtgttaggtgtccaagtagaaagttcaaatcttctgacggcaggtaccttacgtgggattactgagagccagtccctcttcccccccggctctgaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggaggcaccccccgcgaggcggggactgcgagccagaccctcttcctcccccagcttaggacccccatcgttgatcctaagatccttaggacccacctggaggactgtgggtgttagttgtccaggtagaaatttcaaatcttccgacggcaggtaccttacgtggaattactgagagccagtccctcttccccccctggctctgaggaaccccatcacaggagggggaggcaccccccacgagagtggggactgagagctatcccctcttccgcccctggctgttagtacccccatcgcagggggggaggcaccccccacgagagtggggactgagagctatccccttttccgcccctggctgttagtacccccatcgcagggttggggaggcacccccccgcgaggcagggactgagagccagcccctattcccccactggctcttaggacccccatcgcagaggggggagggaccccccatgaggcggggactgagagccagtccctcttctccctctggctcttaggaaccccattgcaggagggtgtggcaccccccacgagggtggggactgagagctatcccctcttccgcccctggctgttggtacccccatcgcaagggggggaggcacctcccgcgaggcagggactgagagccattccctcttccccccctggctcttaagacccccatcgcaggagggggaggcaccccccgcgagggtggggactgagagctatcccctcttccgcctctggctgatagtacccccatcgcagtgagggaggcaccccccacgaggcagggactgagagccactccctcttccccctctggcgcttaggacccccatcccagcggggggaggcacctcccgtgaggtggggactgagagccagcccctcttcccccccggcttaggacccccgtcgtggatcctcagatccttaggacccacctggaggactgtggatattaggtgtcctagaagaaagttcaaatcttccgacggcaagtgcatgatagtctgcatgaaaccctaataaaaaagacagtgaaggagaatcatgtcaggagctgatactcctgagtctcgggaagcctccagggacagagcacagctagagcatccaagaatgagaagagccctagagcaaacgcaaagcccaggaagagataattggtttgagaagaaaagggtccaggagttattgcaacccagctagcaagcagagtcctgggctgatcagagtggggaaaagccactgagttgttcaatggtaggacaaacagagccctgctgcagggaggggacactcatctaccctgtacccccatacacctctgtcccgctccccgttcaggctgacaatgtgctcaccacacagcagcacctcctggtcttgattgttggggccctcgcaatcattgcactggcccgtcctgccatctgaccagagctcttccctgctacactcttctgtgagtctccagcaggaccttttgcacatcagcaagctgggcagcgtcaagtgcctggaatccaccccatgccttcccacctctggacatttgctcatggttcaattcatggccattgaacttgtcttggtcagttttctttcagctctcagtgatagacacattccacaatgacctacagagaaaaaaaaggctcaaattgtatagcaaaccactacctctactaaagtaacctattgttctttagaactgaagaccagaggctgtgggacttcagtcttatctgggatgtggtgctgacatgatgttcccaaaactctttctatctgtgtccctaactctcagatttacttttctctgtgggtgttaatctcaagcagatagcaaaggtagtttctgctctaagctcatgaagttttacagttcctaacgagagaggaagacagaggcatgctctctcccagggtctacatgtgaaatctcattcagggtttctggttgatccagcactggtcacatggcccagccacttggagtcagttgtgttgtcagagcctgcaccgcaagcgcgttgcacagacaggaacaggactggccagggagggaatctccattaggacaaagtggttctgcagaccttgcagcgtctcctcctcaaatgccttttccttacaagagcttcctctcaaaatgcacccctcctttcaggtcccattctaatgctgtcacctccaaagcagcaacctcatctacctgtctcaactccctaaatgggtgactgttcctgcatctgaatttccatagcattatcatgacacaccatcctcaccattgtcactatcttacctgtaatcatagctgcttgtgatgagcagcagctggaaggacagacatcactgccacttaaaccagctccaacaaggcagagatgaaatagaccggaagaaggggcaaggctgtgagggccctgggagcaagcagggacacctcccatcactctttgagggccctgggagcaagcagggacacctcccatcactctttgagggccctgggagcaagcagggacacctcccatcactggctgccatacagggtgaaaacaatacagcctgagtgcccacattccattccagcattccccccagtaagaacaaaacaggaagggcccaaggaaaacacaaccagcagtgaagtggagctctgtcctctttgctgtcctcactggccgggtgcacaggccaggccctactgaatactactacctaagcagttacaccatggccttagtacccccgcccccgagagcagaaattgtaagcaaattgtccatcaaggtataatggcaaaaggcacaaattaggaccaggccaatggtataaatacacctgcctgtcacccagcccctagagctccttggagaagcctgagtcctgtgttccacggacatcagtggcatagaggccctgagttggactcaggttttcctcagggactgggttttcctcagggaatggggcaagttcctgggggccaaggatgtcttctgactggcctgcatgagggcttcaggaggtgagttgttttatcctcctaagaagccgccttggtatcccactggccttaagcagtcccagaatacccataatttttcctgttggagaccctcacattcttctaagcctcaccttcatacttctgtgactactgaaatatcagccacggctaggttcagatttgtttttttttttttttacttttttttttttaatttgggacagagtctctctctgttacccaggctggagtgcagtgatacaaactcagctcactgtaacctctgcctctcaggttcaagtgattctcctgcctcagcctcctgagtagctgggattacaggcacacaccagcatgcctggctaatttttgtattcttagtagagatggggtttcactatgttggccaggctggtgttgaactcctggcctcaggtgatctgcctgccttggcctcccaaagtgttgggattataggtgtgagtcactgtgcccagcctcagatttttttacaatgatgccacattgcaattaaatggacttgtccctactgaacagagccctctgctgttgtgccctggagccaggttaacacgcatgtgctctatgccacgaagaacacccaccaagctgaggggccctgcaggcattcacatgggaaactgccattgcgaatggagtgagtgaggcagcttaagtggtgggaggggtgcatgggaaggggctcctgagcaggaccttcaagggtgctagagtttggcagagacaagagtaggagcgaagaaagtgagagtctcatgtaaaagggcaaggtcaccttcctgaacagggaagataaatcatagtggatattgtacaataaagattttattcattcatctatgacaaacttttactcgataccaaccatggcctgatgcaaggctgacaccatgggatacagaaatgcttttgagtgtcagtctggggagagacaggcatgtgagcaaataaatgagctgggtctgtcccatgaagagtctagaatagtgcagttggttagcactctctggtgacagaaaggctgtctatctataccatccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggcatgagtcaccgtgcctggcaagagactcgtttgaagttgaatgaaacgaacagaatttggcaatggcttagttgggaaaggagaggttagcagggaaggggcagctgcagcatgtccttaggggtgtcaacatttgtgctgaacacaggccactgtgggaggaggcatcggcttgacacagcaatcctgtggtggaggtgtttgtattttgaggttattattctattgttgattcttggagtaataagaattgagagattacccagaagcaatgggcagtgtaataagaggagagggctggagaacaagctgggtgactcccatgtttacaggcttctggcctcagggaaggcctggaaaaaaggatgggaagaagatgctgttagaatccaggagaaagctacctctaagaaagcaaaaaaggcaggctcatagcagacaagtaacctgaattgggaaagggcccagtggccccggccttggagggcagctggtgtctgcagggagggtggctttggcaggagcacaggtgtggttgaggctgaggtgaccaaagtcggattaacacgaacccgaggcacgtagcacagggggatgagtgtgggggtttcttccgggctgctgcacaggccctcctcttcccagacagcagctgctgagtgtcaggtggggggataaaggccagaagcagagatgccgctaagcccacaaacaggtgcccacgggatcagcctcggcgcccgggcgggtcttaggtctgaaggacacttggagactagatgttaactgttggaaatttagtaaactgggccaccagaggcttaattcactgctttaaagtctgatgattggaaattaacctatgagaattgtcagattacattgaggtttgatctcccgtgcacttacacaaatgcacacagacacagacacagacacaggcatgcacacacctcttttatgagacagataaaaacccagccacaaagatgtcaatgccacacatctaagagcctgtcccataagtaatgcacagggctccagcccccgtgggaggaagataattggactgtaaaatagtgaagggcacggctgggtcaagagagagtcccctaaaaccaaattccagatgatttccatattctgaatggaaagcctgcataatcattatttttaaaacatatcgacttagaaataaaatatagaagtcaaaaaatcaattaagaggactaattcaatgaagagtgttttctggtggctatttttctttttattaaagtttttaatttttttattttttgggcacctagtatatatttatggggtacataagatgttttgatacaagcatgctctagtgactacttttcaagagttaaactgtggactccagagtctgaaaataaagtataatttttgagaatgttcaaattatagttttaaaagtctttggcccattatttatattttttattcttatttggaattaagcacagtattttgttttttcaaaaatttaaacctgactgagagctaggttgtcatggaccattggttatttatcttcttttgatgatacttcatttaataacaaatcagtgttcctgtgtctgatagagttagatgaattaatcaagtcagtgtttattcctccttcaagtggcatcttcttaaaggtagctttgcaaaatgcccaattatttggacaacttaaaaaaagaactatggggccgtgcgcagtggctcacgtccctaatcccagcactttgggaggccgaggcgggcggatcacgaggttaggagatttcaggccatcttggctaacacagtgaaaccccgtctctactaaaaatgcgaaaaattagccgggtgtgatggtgggcgcctgtagtcccagctactcgggaggctgaggcaggagaatggcgtgaacccgggaggcggagtttgcagtgagccgagattgtgccactgcactccagtctgggcaatagagcgagactccgtctcaaaacaaaacacaacagtttctcatatgcaatgatccccacaccgaggtatcaggtaattgtggactgtgccgttcactgtgtactatcaggaatttaggtaaggcagcaaaagagaagaaagtttccctagagctccataccgaggtatcaggtaattgtggactgtgtcgttcactgtgtacagagattggcagggtgtgagtggcagaaagagcttcttaggcagtcagaccacctggctctgaatcctggctcggtcacaaattaattatatggaagaaaaccttaagcctcggtttgattttctcctttaaaaagtgagacaaataaatgcatttatttctcagaagatagttgtgatgcatctattattttatgacatttttgttcatttttaaaaggtcctgacaaattttaagtgttttatgtgatcagttagatgacatgctaataggcaaaaggcttgcctctaatatacatgctgtcaaattttccatcagcttctatatttgcttctctaagatttttttttcctgaatgacataattaattaatgaggtcatgcaaaattcttaaggaaaatagctaagtcagtttccttcattaaaatccactgtaaacaaagacggccctctgtttaatgcttagtttaacagaaaatttaaattagcacagataattcttcacatcatttggttaattgaaggtatgggaaactgtatttgtagtgttcactcaaaccattcccaataagtgaattacccatgggccaaactctggaaattgccagatgaactgtattatataaagatagtatggcatgaatagctgttctttcatattgcctttaatccatcctctttgaaataatagaggcctgagatacatcagtgttattgagcaggaacgcttgaatataaaaccaatcaagacaacatatagtatgaaatagtagcttatcatgtatgtgcatgcatgctattttatttgttttttgctgataaaggtggaatgatgttatgatgaatttcaccatgaaagactgaaatagagcaaacaaaacgtctcaatcagggtttgccagggttattcctaatgagttattcatactggttgtatttttttgaccattgggatttatttatctgagggctgctggaaaaaggagaaagggaagctacgtcatttgccttctgtgtgccaggcattttctctttctttatccctggaataaccttgtgtgggaggtttcattattctcattttacaaatatggaaactagcttagatgaagagagatggagtgaccctccgaaggccttgcagtcagcaagagttcgaagcggggtgagaattcacgtgtttctgatttctaaagccgtattccttccactgccctggttcacatgttagaatgtcacatctttatccttcagacatagtagctcagtctgcatcagactaagatggggaaaaacttgattcctggaaatttccaaacatacggaaaagtggagggaattaggcgataagccagttgtacccatgacccagctgtataattatcaaggcttcggcaatctcgtttcatccatttcactaccactatgatttgaaacaaatgccagatatcatttttctccgctaaaaacattttattatgttggatcctgtttgtgcccgtattttatactaagccttcacataagttatgttctaggatgtcttcaaatgagagtaaaagaggacaccgttgtcttactgctggggaaaagagagggggctttcttctttcttcaacttccctctgtgatacaagggaaaaatgcagctaaattagtctaaaatctcgatcccttgaaaacagaaaaatcaacagttttaagcaaacaaatacaatccccctagtagctaatcattttcatccacgtgcctggtacacatgctaatgttggagggaaaaaaacagggtgatgtgctttttgagtgtggacaccagagggcagagtgtactgattagagtttcctggcattgcaaaagtgcagtgcggcttggggaggaaaagcagtaggctatgaaacattattccttatgtcaatagaaggaaattattacataagggaaaactggcaagatggaagagcttatatccgcttgcagttctgttcattccccctaaactccatatattatttcaggattttcatgagaaaggctcttctttgaagaatcaattgcttatccatggtgttagtttatatgtttgtatcatgataaacatcctatccagaggtgtgaccttccagaccttgctaacagcatgctgctgctttgcaaagctgcctgcgctttgctgctcacctaaaggaggacttctcaataatagacaggatttgattcctttttgtcatgagaaagctccctgattgtgcatttgtaatgcatgaattgcacagatctccctgctgagaggcttacatcacagagttggctcactgtttccagtatcattcttccagcccaacagtaagcactggcagagagcaggtagctgcctaccctgatattacgggacgtcaataggctcttgcacgcaagtgtggtgtttttcattgcacaccaagggttattaggctgtgctgagtcagatggaaataaaaatagcctggaacctgtgcccgtttgtttgggggacttgtcccagcaccatgctaatgagcccaagggcttgggcttgatgtccctggtggttccatcagagcaacatgaaggaaagcaactgtcggaagccacaggccctcacttaatgtggtttgcagagtggtaagtgatggctcttcccacgggtatggttgtctggcacagagagagccgggggacccacacgctcacgcagttcctgccagcaactgtgagacatgacgactgtgacttagcagaatccagggttcatccaccctcctgtgagtcctcctgctccccgttttgctgccatctcgggccaatatctgcaggtgcagagaccctggagtagctgcacctcagcctcatgtcctctgtggtcccttaattgcccaaaagaaagaatttaaatgtaaagtcgctctgtgcagcgagcatgttccttcgtgccctgggcggcctctctgacagccctgactctggtctgtgacgctgggattgtggctgctttcaggcaccgtcatggccttccatggtcctctgtctgcctttgtctccttccttctgtttaggatgccctttagtgggggaactcctggtccgccttcttctctaaatctgtgctctctaccaaggattttccaagcctgcgcttcctcctgtcgtctcctttgctcctctccgtggctctggctcctgttccgcagcccctggacctatatctgtgatcacacttagtgttttatacatcagttattcacttaagtgtcggccgtgcccaccagcccagaagactcaaggacgagtacttttctatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttacttaatgtatttgaaagtaagttatttttaaataaatatgaaaccccatctctactaaaaatacaaaaaattagctgggtctagtgatgggtgcctgtaatcccagctactcgggaggctgaggcaggagaattgcttgaacctgggaggaggaggttgcagtgagctgagattgtgccactgcactccagcctgggcaacaagagtgaaactctgtctctaaaatatatatctatgtatgtatgtatgtatgtatgtatgtatgtatgtatgtaagtatctatctatatatctccatatatacatatagagagagatatatagagatctatatagagatagagagatatatatagatatctatatatatctctctatatatgtatatagatatgtagctatatatagagagaaagagacctggagaacatatatactcaacaggtgcatgtcataaccttcggggaaatagggtgggaaggatgaagatgatattttatgtgatctgtactgtgtgagttgtgagtttctgcatatattaattagtaaaataggtaggagcaaatattatgaaagcattaaaacaccaagactaaccaagacaatcatgaagaggaacatttctgtctaactagatggcaacttattataaagtcttagtaattctgatgactataccccacatggatgcagagacagaataagtaaatcagtggaccaaacagaaacaattggtcatatttacacagttcttgttaccagctgggctgttttaaacaactttccaatataaattcatttaatctttgcagctgtccatgaagtaacgtttataggtctccatttaatgctttaagaaaatagaaaaagaaaggttaaattgctgaaagagtcacataagaggaattggcataagagacacaccggctactccctgggtgtgaagctttatagccacagcagggaggggagtgtcaagaaccagggcagggaggataaagaccccgctgagagttccagctcagtttatgattggtatatgcctttcataagcaagtcactattttcttgaaaagaaatggaaatcaagagatgcatgtgttgtcaaagcgggagaaaatatttgcaaactatgtatctgacacagtactactatccagaatgtacaaggaactcaaacaaatcagcaagaaaaaaacaaataatcccatcaaaaagtgggctaaggacatgaatagaaaattttaaaaagaaggtatacaaatggccaacaaacatatgaaaaaatgctcaacctcagtaatgatcagggaaatgcaaattaaaaccacaatgcaataccaccttcctcctgcacaaatggccataattaaaaaatcaaaaaataatagatgttggcatggatatggtgaaaagggagcacttctacactgcttgtaggaatgtaaactagtataaccactatggaaaacagtgtggagattccttaaagaactaaaagtagatctaccatttgatccagccaccccactactgtgtatctatctacccagcagaagataagtcattatatgaaaaagacacttgcacgcacgcctatagcagtacaactcacaattgcaaaaatatggaaccagcctaaatgttcatcaaccaaggagtagagaaagaaaatgtggtatatatacaccatggaatactactcagccataagaaatgaatgaaataatggcattcacagcaacctggacagagttggagaccattattctaagtgaagtaactcaagaatggaaaaccaagtatcgtatgttctcgcttttaagtgggagctcagctatgagggtgcaaaggcataagaatgatataatggactttggggactcggggggaaggctgggagggggatgaaggataaaagattacacatggggtacagtgtatactgcacaggtgatgggtgaaccgacacctcagaaatcaccactaaagaacttacccatgtaaccccaaaccacctgttcctcaaaaactattgaaataaacataaaataaatttttaaaaaagagatacatgtgttgaaatagacaataactctcaactgtaccagaacctacacctccttattttggcaaattattttaatgctcctttcctaatttaaattaaattcataggtgataaaatgtatatgcatataccactttaaaagtttcaatatataggctaaataaaggaatgaacttataatccagttatctgtccttcagcgtgtcactgctcaggtcctgcttgccaggtggtctgcagctagggcactgacatctgtgatgaagtcagaagcttcttcctatgtgtaaagagtaaaactgggtttaaaatatttttttttaaaaaaaaggctgggcgcagtgcctcacacctataatcccagcgctttgggaggccaaggcaggtggatcgcctgaggtcaggagttcaagaccagcctcgccaaaacggtgaacccctgtccctactaaaaatacaaaaattagccatgcacagtggcgggtgcctgtaatcccagctactcgggaggctgaggcaggagaatctcttgaacctgggaggcggaggttgcagtgagccgagattgtggcaatgcactccagcctgggtgacgagggcaaaactccataacaaaaataaataataaatttttaaaaagcagaccagaaatagttccatataaaaaatataggaaaagggaagagcagataatacagaagaaccttagaataaagcctgagattaagtaataatagattagttttattttgaaaatgaaaagaaaatggggacacactccatttgaaatacaggatgcgtaccaaggtggatcacagattgagaggagaaaatgtgtgagattctccactgatagccaggtgtggcttcttctttttaagcatggcgtgaaacaaattatgacatggatgatgagggcatgaagtgtccctgggatcctaccacctgacaaggtgtaccctcagtctccaatgcttaataaatgccttgtaaactgtaacctctgatacttaatgaggaatacagcgctttgaaacagaaaccgaaataggtctctagagaagttgtatgataagatcctgggggcagtgtcagaaaaggaccgaaaaaccacagattcctccctccaggaaataatttcaatacttaaagtttaccatgtagatttcttgttctggtgctataattgtgaagcatataggaaacactataaaatgttttaaaacaatacttttgataaactttattaagacctctatgtttcatgtgtttgcactaaaaataatgtttgcttctaagaatgttcctatttgactaaggtgatttaaaatgcctttgcattgttgcactgtttgtgtagtgattgtaactctgtactaaagccaattaactttgtagttggatgggttataaaatactcactagacacagtactccatagacaccatattcaataatagacacaatgtgtagaatgaagaagccagcgtccacctctgcaacgagcttgtcctgaatccctggaccctttatttttcatcccataaaaactttcagtatcattatgtactgaagtactccttatttatagttctgtggatttattccaacgagtctgttgaaaactgggatgtggggcacctacacttctcaccgtgcaggatctctacccattgcagggtgtccagccccctggcctctaccccaaatgccagtgaagtctaggattcattgtgacaactgaaaaactctcctcatttcaaaaatgcttcctaggaggtagaatggccctgttgagaaccttaaatagattatagattttatttattattattattatttttttttttttgagacagagtctcactctgtcaccaggctagagtgcagtggtgtgatctgagctcactgcaacctccgcctcccgggttcaagcaattctcctgcctcagcctctcgagtagctgagactacaggcacgcatcaccatgcccagctaatttttgtatttttagtagagatggggtttcaccttgttggccaggatggtctcgatctcttgacctcatgatctgccctcctcggcctcccaaagtgtcgggattacaggcatgagctactgctcccggccaatagattatagatataatttttctgttattatttctttcacaaaaccctggctgtacaagtatcctctgtaaacttagatatttccgacagtgtgtctacttccttccttcatgatctcaactctctgtaaattacatgtgaatgcattcaggactgtattttatatatcatctctttcatgttttgatttgctttttccaagcagacattaagtgtgctgaaggtagttgtgttgtcatctgctttcattgaatccttcagaaattttagcaccacaatgagattctgaaaaaagcacagaaaaggggcttaatatagaatgtttaaagaatatttgttttctcaatttatattacgactttcaaacttcagtgcatatgtacacacacacacacacacacacacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttccaaaaaaaaaaaaaaaaaaaaaaaatacctgggccgggtgtggtggctcacgcctgtaatcctagcactttgggaggccgaggtgggtgtatcacgcggtcaggagatggagaccatcctggccaacatggtgaaaccctgtctctactaaaaatacaaaaattagccaggctttgtggtgcatgcccacagtgagctgagatcgcaccactgtactccatcctgggggacagagctagactccatctcaaaaacgaaagtgcctggtcgtctttccacacaactccgtttccactcccataaaatgctacgttagctgttttgagggtagatgcccttagactgccaactcacaaagttttattgggcacctgttacctgttcagcagagatttgtaaaaaaagacacatcaggtggcctttgcttgcaagaaatcagcctttggaacctgtggagaaaagttaagtactgcgtactgcgcaaatgaagggtgggagctattgaagggaagagactcaccccgaaaacccaagaatggtcaaacgagaggcaaggtggagcctgcagttttcactggaaggattctagagtgagtgattctggggacctagagatgggggataacgggtgaaaggaacaagcacggcccctttgaggtggaaaacagactggtgggccagggttgggagggtgtgctggggaagtgttgtgggcagaggctggaaaatgaaattgggctggggttaggagacaggtgaccgtggaagactgctctgacaatcagagtctggactttgctcctctgcaggatccctgatgcccagatggacccttcgatgttcctggcccacctgcgctacctattcttgccccgctctgctctagtatttacaactgcacgatggcacagttggtctctgggacttagaatttgtgttgcaaacacaagacctggagaatggacctggtctgtgatatagtgtgtcagtcagggacctggagaaacagaaggggatcccaaataagaagacttgaaggaagtttaagaaaggcaccaaatacaatttgaaacttgtgggctgggaagccacacgagatagcgcaggctgggggatgtgcaggagctgtcatcagaagccggaagtggaacatgttatgaaaaaggtcacttttcataacactttgcatggagaaggagtacaagggaagtcaagaggacccacagtgggaagtgggctgtgaatactctgatcctacctcatttactgccagtgcatcccttggcctaagtgaagtaggagcttgggagaagattggccgttgactctaatcctgctcccaggttcctacttaatcagcatccaagatcaaggtgtggagttgacagtgacatctcggacttcaatccaccatgttgacttctgattaaccccagtcctgggaatacctccaagaattctactttatttacttctcttatgtaagaatgtttaactcaccatggatcctgcccttagaccaaagcgaccttgatgttattgcacaaattacaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgctgagaaaacatgagatgtgtattaccttctgctctctgtatgtaaaacagctgaagctaaatcccttgagatgtttctacatccatctatacctagatcttggaaattttgcaaataagcagttgtcagaattttgagctatggcttagggtattaaaaaatagaaagacaagggaagagggtgttgatggaggcttgagccacttagcatgacctagcccctgatcagctgtggttagtccaaatgagccagtatgctggggcagagagcaggatggagtagcaaaggccctgtagtgaggccctctgtgggggatgagtgtgcttggtagcagtttgaagcattgtgcctctctttcctatgcactgtgatcagtgcacaggaatgtagaaagggccaagcctttcaacaccttagactctgatgcctccagggtggattcactgtgccatggaaaaccacataacatcatcctattagcgtacttttgagagtagatgtgctattaatgatgctaaaacaacagacatacactaccagaatgctcctagcaaaatgaggacatgtagtcaccctttcctctgctccctccccaccacctgtgccattagaagctggaggagggagcggtcactgtggcatggagtaggctgggcaatgaaggcttctaggaaaggcgggccttggttcatgatccgtggtgggattcatgtgggtaggagagaaaatcaagggacgtcaagagcgtggtaatagcttgttactacctggggagaaacatatctgctagagttgccatttagagacatgtcaaaacctccagaaagtgtgtttcaatgccaagtgctaattgtaaaagggaacgtgtctttctgcagttctagtttgttatagaaagggacagctcttgacgttagcaaataaggttgtatgttatggatcctgtggcaactgagtgtatgtgacggaaaatggatgtttactttaaggtcattactgaagactttctggagccacctctttcttggggacgtctccctactgattcatattagaaatcaacttgagtgacctttctcttcaaaacatcagagactgccttggactgtgtggtctgcttggaggacttcaaccctcttagaaccttactctgcatgtgaacacagcagcacaggggcagcgggttccatcgtctacgggagatggtgctcaagggttggagccagtccccctagagagtcacatagcatttggccctcgaccatggctgaataaatgaatgaataaaccttatttaatatatactttcacctgcctgagttgtagaactctgcagaagtccttttatatctcttctacattcatcttcagagccattgtatcataggggttgttttgttattctccatacatcctaatttatagaggagaaaacgaaatccagggaaagctggaaaattgatccagggtcaaacactgaacttatggagaggatggagaggaaagcgtggcttttggagtaatactgctgagagtcaaatcccagttattgcagtgaggagtagcaagaagtcacctaatttcaacaacacaatcatttcaggaatggaaagaacacccccagttccattaaacgacatgaagtacagaaagtcctggctcacagaaggggcccactaagcattagttgccattcctttcttaggtaaccaccgcctgtggaccctcaccccttcctccactgtcagaggcagcataatggctcagtttgcatttcaaggctgatagaatcaagtttgctaatgctggtcctgctgccacctagaactcccttaatgaaagtcagcctccacaaaccttgaggagtattaaaggacagagccctgtgaaggatggtgctgtgtgtgcctatcttttctttttcttttttttttttttttttttgagatggagtctcactctgtcacccaggctggagtgcagtggtgtgatctcagctcactgcaagctctgtcttctgggttcacaccattctcctgcctcagcctcccaagtagctgggactgcaggcgcccgccaccatgcccggctaattttttgtattttttagtagagacggggtttcgctgtgttagccaggatggtctcgatctcctgacctcgtgatccgcccacctcgacctcccaaagtgctgggattacaggcgtgagccaccgtgcctggcctgtgcctatcgtttaactgactagttggattagtgaggagtcggttagttgttgtgcttctttgcagtgcactgggctgctacatggacctgattttgactacctgttctaagggatgaggaagccctccttgcagaagcccatggaagccctccttgcagaagaaatatcccagccactcaggttggcagactctgtgcagaatacccagtgtctttcctcctcttatttatctctcttcaggtaccaggaagtgaaagaggcctatatacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatgggtatggggacagctctagggacttagcttcagctgtttcaaataaaggaaaaagcagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatgcattaagacaggcatggatatttccatgttcttcctgaatcacaggtattgagaggaagtgtgggaaatgggagaacagctgccttatgaatcatgaggttcacctaaaccttgggggctagaattgagatggagcagtgttctgaggggtcccaagaagcctagtataactcataagatgcttgggagtttaaatatgcttttctgtgcagagtctaccatctaagtctctctggtttgaagttggagaaactgaatttgtcattcagctagaaaacatactggaggagagattttaactcatgcctcagaacaaagctcagggctttctgaagcaccagagggtgccaaaggagtcagagcttgggttctgcccattgagaagaatgaagagggatgctggtttcagtttagcaggaggaaaatggtaaaaataacattgaaaagaacaaatagacttacaagggttctcaagatttatctgcaagtgatattttctaaggagactgcgtgtgtcccccaaactccattttcatcatgtcacatttttctcaaaagcatttctataattctagcatgagaagggaagccttggtctaaatgttcatgagcggaaccaagccgcctttccagcctcatcctgcaagcacatactccctggctgcaggtaggtcccctggtagtgtgtagatgccagcatttctgttttaatggtacatggagagaggcgatctaacctaacaacaaattgatgatctagcttgaaaaaaataccaactgccatttctatcaccgtaatttcaaaagcagaaggacattttaacatcaaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctcaaaaaaaaaaaaaaaaaaaaaacaggtgcctttataaaaccttgttgtatctctttttcttttgttttaatttaccacaaattcagaagagcttcattatccctagagtaagaaagggaaagaataaagaaaaaaaaagagcttctttaaagaccagcaatccgtggacaggcatttagcagttactgacttagcctacacactgggctgatatagtttctccatctggaatgtccttttatctttcattttatccaattctcaacttcttttccatcccaaagaatatcccatcgccactctcaagcttttccggacattctgcagtaatatctacctcatctgaactgaaaactctcttgcctcttgtactcaattggcctttaccgttcactgtcttctgacatctcttaaatagtgatgagtcattaatgcatctcgccaactagacagtaagcattttatacctctttttaatgtctattattttcagaaaatatgtgatacctaataagtaagtttttaaagtttgctgaacgaacacagtaagttctttgttgtactccttgttttctggaactgtgatgttgtttatgtcgagtcccagaagttaaggcagaagggaattgagaaactgaccctgaaattatgtcataaaaaactgagagttaaaaaagaagccatggctttctattgcaactttaactttcctagtatgcttagtacttattttttatttttatttatttattttttgagatggagtctcatactgtcacccaggctggaatgcaatggcacgatcttggctcactgcaacctctgccttccaggttcaagcggttcttctgcctcagcctcccaagtagctgggataacaggcgctcaccatcatgcctggctaatttttcgtatatttagcaagacagggtttcaccatgttggccaggctcgtcttgaactcctgacctcgtgatctgcctgccttggcctcccaaagtgctgagattacaggcgtgagccaccgcacccagccagcatttatttctaagccaaatcaaaatatagacctttgatgaaggtgttaagaaaacattgcattgtcctggttatttagagatagagacataaattctctatgattatttctcccaaagatcttggaatccaatggatctgagtcaggtcaagatgaatgaatacaaatatgagaagggcatagctcatcagaaattcagagaccctgggtgagcagggttaggcaacttggagaaactttctagacacaggagccatagcactgtaactaaagaaggaggaaaacacagcatgccgagcagggtatagaggctgcaggtgtgtttttccttggctttcatgctgtgctggccctgacacaggactgactttacccataaagaaagtggcagcagcaggaagggcactgtggtgagccctggtgaatccacatggcacttggaccaacccctcagacacaacccctttctcattctgttccatctgctgccctacacgatgttccatttcagggctcgtttctgagcatggaccagttgctaggcacagttctgcagatatacagtgagcagaaacaaccacagagcttactcttttttttttttttttgagatggagtctcgctctgtcacccaggctggagtgcagtggcacaatctcggctcactgcaacctctgcctcccagattcaagcgattctcctgcctcagcctcctgagtagctggcattacaggggcccatcaccacgcccggctaatttttatatttttagtagagacagggtttcaccatgttggccaggatggtctcgaactcctgacctcatgatccacctgccttggcctcctaaagtagagcctacttgtatattgctaagggcccagtgaagaagccagggatctgttaaatatctcacccacacatataacattacacatctgaggactgttgtcaaatgaaatgatgtggttcagggagaccaatgagtgggatgtggctgctgagaatgaggtgcagggtgatgttacatatttttttcccaagaaagggatgtgtaggctgacagctaaagtgtcagtaggtgctcactagtttggaacagaagagaacattgttcatgcaaaggaacagcccgaatgaggctgtgggacaggagggagtgtcacggggctgacagaatgcccacttggctggcacacaaggaagggaaaggagtggtgtgagatgaagctgagcaggtgtcagcaccaacctcttgggactttgcagagtatggcacagattttagcttcattataagagtagcaggaaggcactgaagagtttaaattggcaagtaatgggagctgaactgtgcttttcaaagactactctgtctgctctctacagctgaagaaggactgaatatgggttggagggagagagtgagagcaagcgtagctgggagcaaacatggagtgtaagagcagaggagagaattagccgcaggccagggaccttggaaggacacttctcactaaaagccacactcagctagagagcctttttaacagtgagtgattgttcttctctggtgtttctctctgtccgtccctaatccaagccaggagagaatgaaggctcttagtttaaaaggtcctctggtcctttgctgccccgttcttgcttttctagccagacatggttctctgaggatttgttaaattttatagcccagtggtcaagtaaacatggggtggtactcaaagaaactcacaggtatttattatccaaagctactgcatttggggattattaaatacagacatatagacacatatgtatgcaaggtcattggagtgacatcccatcctgagaacaggggccaccttctacaaatgccaaaaatgcacttcgcacagtgttggaaatttcatcgggtgttcactgaatgcacagacctgctgcagagcctggttcttgtgtctcttgtcttcctgggtgtgctgggatggaggacagattcttatgtccctcattggaatctaccctctcagccagtcttgtgaccacacttttggagtgatggagtgatgggaagcccctcgtggcacagcacctgccccagcaccattggctgaaacggaaacaaccatccacttggcctagcagagtccttgactatcttttagggctttgctctgggaggggctgtgctctctgcctgcctaatatccccacttctggcccagtggggcttgggctgcagtagctgcattccattctggcccatcacgtggcaacaccaaccacgatgcctgccgttttccctgagatgttctgtgccctctcttctgagacactggtggctttctgagaactgctgtatggtgaactccatcttcaagggttattggcttccaaacaccatgacttgcgggagccccgttccctgctcatcagtgtccatgcaattcaggcaactctccccagctatgctagttacttccttcatctaaaccctgtttggaagccctgaagttcctgcctggggaagtcaagtaaaaatgggaggtatgggacttgatagcagcagatgtgcaaaggtcttacaggttacagttgagtctcagtgtgagatgggtcactgggggatgtggcccctgggcagctagtgctatggagtctgtagaatagaggcacagtgatgaccagttatctctggagcactgtgctcagttctaggagacacatttttaagagaaactcgtgctttcctgaggaggtctgggtctgtgctctctgatatacggtagcctctaaccacctgtggatatttaaattttatgtaattaaaattaatgaaaatttaaaacagttgctctggcactggccacatttcagatgaactggagccacatgtggctccggctggagtgtcaggcagcacagtggagagcatgccctgtcctctggaaggatgtggctcagagcacgtccagcccagaagtcacagagccaggacctcatggagtgagaagtagttgaaaacactaaagttgtgtaccctacaaaattgtcctcagacaattcagaatctatgtcacagaagcagaattggatttctcaagagtgactcacaacagcataacttggattaactgaagggatgtaaagagaaggttttagctcaatgcaagtccaacatttccatcagaagtgttcaaaacgtggaatgcgagtctccaggaattgtgatttttttctttcgtttaagacgttcaaatagagactgctgtccaattattgccaatgctagggagggcatttctgcctcagatggaggtagtgaggtgtcagcaaagaatgtggattttagaactaggtagatttaacccaagtcctggttctatcattttctaacttaatggctttgctcaactcaccacacccctccgttctccccagtaaagtgaggacaatactaattgtctcacaatactgtgttgggtgttaaatgagaccacaaagtaaagtatcaaaggcagtgcctgtcccagagcaggtgacttgcactaatcagaggctcaccctgccttgctgctccacacacacgactgactgacaacatccgtgacccacaacatccacagctcattcccacggcagtcctcacgcaggcaccaaaactctaccccactcatgaaatcgacgtgaaatgcaaggaaatcagaatgtggttatctgaggtatcgactttaatcttctctggtttatttttttaaataaattagttacagagcgagactttaatcattatcagtagcagatttcactagcacaattatcaagtgtcaaaaccccaaaggtgagaatcaccgttcttggagcatcctaagccctgtctacctttagaggttccaatgctggcatagggttcaagaccatatgttttattatgaggaattcaagtgagaccagactgttttgttgtaaatactataagaaagacaacatcctttcttctcctccatttctatgcctgtgaagatgtgatgagcaagccttggaagcctcagttcctcagactcttccaggcatggggccatggaacttggcaaaagcgggtgctgtgtggatctcagtctctggagccattcgttgggtcgtgagcagcaaagtagccttcatctttcccagtcttcacacttcgaggaccctcactgctggtggggagggggtttctgctctaggctgtggtaatgctatcccccgacctgcaaattcacacaatgagccaactggccacatgctccaaggagctaagatgctgttggtccacaaacaaaggttcaggttctgtgtagcttaggatccggttgctaattggcttgaaacatttaaatcctcttgcatttagttgaatatgtggatatgcctattgagaagtatgttatgaaatctagggtttgtattcccatccgtaacaggaagaataaaaccttgaaaaatgtttcattttaaatacagaccccttgtgtatcaaaaagtatatttttttgggaatacaaagccaccaccaccaccaccaccattgcccatagaggcgcctgcagaggctggacttgctgcttctggtccgttgagctgagaagcacagaggttcagtgggttgttgagggcaccagggaccccaggtggaactggtaagaaaagctgaatccaatccttggcttttactcaccttgtttaaattactgtccttaagctttttccatattagcctggagccataaatagtttgtgtggctactttcaaaattcaattctgggccgtttgcggtggctcatgcctgtaatcccagcactttgggaggccgaggcgggcggatcacaaagtcaggagatcgagaccatcctggctaacacagtgaaaccccgtctctactaaaaatacaaaaaaattagccaggcgtggtggcgggtgcctgtagtcccagctactcgggaggctgaggcaggagaatggtgtgaacccaggaggtggagcttgcagtgagccgagactgcgccactgcactccagcttgggcaacagagcaagactccttctcaaaaaaaaaaaaaaatcaattctgtgcaattcagtcgtatttattgggaagcctttaggttcccagaagaactgagccaaccttgaagggaacaggaaagaaacagagcctgtgatcagtgggcactcacagcaaataggaatcctccgcctcccctgcttagaaacctccagcaattcctcaggggtgcaggtagaatctcagtccagcagccaagggcttacgtattttgagcggtctatggctttctgttgagcagacttatagcttctcatagctgggcatatttctatttcctgggttatctgaatgcatttcttgtaaccctggcagaagaaaagtttctatcagccctccttgtaggaagaaaatgtgttccctagtttgtaggcagcagagagcctgctgtgttagttgtgtcccgtcagaagcatttgagaaagtctctcgcggtataacaatggcagttttttgcttgagggacagagagagagcagaagctggtgaatctgacaggcaagggtccctaagagaaaggataaggtccctaagaaagggccccctgccctgccttcctcacctcctcttccccccctcaccacgtggcctcaggagatagggcggtgtcactgcctctgctgaccctcccgatgtaccagatgaagagaccgggtcagtaacgcaaggagttgatgtggacatccactgcccagcattttgttcatcgtgcagctttataaactgtccaaagcaaggttcagaagaggcaggattttgcaaaactctcacatcagttccatctaggacgtgtggacatcacagtgattgggatgatgggctggctgacccttggtggttctcaacaatttccaggatgttgcatttatttatccatgacatgacatcaggggtgggagctgtgcttatgcagaaaggggttctcacagactggaccatctgcctacctgctctcccacctgtgtattgtatctgtttatttaggtggaattttaaatttagaaaacagttgcaaaaatactatgacctgtttatatcctttactcagatgaccaattgtttacattttgctccacttactttattattttctctctttctgtatttaccaataaaaagagcattttcttacagaggcacaggaccgtgaccagaatcaggacattcacagttggcacagtatcggcgtctaacctggcatcaacattccagtttcacctgctccctggcacactgtggaccactgccaccttggtctgggatccacccaggcctccagtgtgtgtagttgctctgtctccttaatttcctttcaactagaatatttcttccctctttctttgcctgttatggcctttacatttttcagaacagaacaggttttctgtacagtgcccatcactatgatttgtttgatgtttcctcataattagaattttggccagaatcctagagaagtgatgttttgtccttgccatgcatcctatcaagaggcacgtgatatcagtgtgtcctgctggcgatggtcattttgatctcttgtttaaggtggcatctgtaaggttttcccaccgtaggttgctctatttcctttgaaatgaacaagtaattgtggggcgattttttcggactatattcatatcttttgactcatcaaattttcacctcctagtttgggcatgcattgatgattcttacccgagtcaagtattattacaatggttgtcagatggcaatcttctaatttcatttctccgtctgcgcccatcagttggcattctacaaaaatatggagccgtcgtgagcttgcgtctccttgtgcaagagctgtggctatgctgagcttctccacatatttccaactttagtacatgggcaggtgaggcaagcaccactcttaccttcgaacaccacacacacacaccacacacacatatcacataatacacaccccacataccactcacacagcataacacaccacataacacacatcctacatatgacatcatacatcatacacaccacacacacaccaaatacaccacatgccacacaacttacataccacatcatacacatcatacacacgacacacagcacataacacaccacatgccatacatcctacatacatcatacacaccatacacacacatcaaataccacaccacatgccacacaacctacacaccacatcatacacagcatacacatgcatgacacatagcacataacacaccacatgccacacaacctacataccacatcctacacaccacacacaccccataacataccacatcacataccacacacaccatataccacatcatatacaccacacacaaaccacacacacaaatgcaaacaccacatacaccatacatacccacacacacaaacactgtataccatacaccacactgtacacaccacaaacacacacacaccataccccacacacacaccatacacacacacacacacacaccatacacacacacacacacacacataaaaaaaaacttctgttgaggctgtgcccccaccacttggagccactacatctccctacctcaacttctttccacttggtagtcctgtcttctgaagttagtaaatgcaggcgtgaggcagggaggcgctttggctgattggcggaaccctgggatgagccacagcatggctgtgtggcacgtgtggtgtgggtgtgggtagggggatcccgccgtgcttccttcccaccctgagtcccgtgtgtgccccttacagtgtgtttcctattaaagttcctttcatgtttgggccaagggtgtttcctttaattcctgctagcataaaagaatgaggttttctgcagcaatttctaagtctgaaaagggaggctctggggtaaaaatgttgaacaattaaaatgattagaaattatctatataaaatacaggtatacaaaatatgtatattgaatcctagctagacagacggtatccccgggagaactcctccttgaggaatgggccatttgcttcataatagatgcgagatcatcctcgggccagttagcatgcacagtttcccgggatgctttgcgatacaaattcataaacattgattgaaaggtcaggggacgttcccatcaacacgcggctctgtcggattgttcaagggaaagttagcactgttgcatgcaggcagttgagttcttagggaagagtgctggccctggtggagttttccatgtctgtgtgatttggtgtggtgtgatatagtcaatgggacttggttcggcgcagggagagctgcatgtttctgctcatgttatctggaaataaggattcgggctctgtgtgctgaattatgtttgcggcgatctcacagttgtgaagaagaggcatggctgggaggcatgttcagagctggagagggtataaaattctcatttcttaccttctctgagggaaggagtgtggagtggcagatttccagtctctgggtcttatatcagtgtcgttctctgggaccagcactgtccccatatgggtaccactgggacgtgtagttgacctctgacgtgcacggcagatgcacggacaggcagggtggtgctgggtgagcattagccgtgtgcagctggtgagcctatgccttcttgttggcaggcctcgctgctgagagtaagttggtgaggacccatgcacgtaggttctcacatgtttccaaaggtcccttcctgcctcactggtgagcctttctcccaaatgagaactcctcgctcttgcctccctttctactttctacatcttcctgggacttcctggccatctcctttctgcatgcatgctgcaggaatttccactccagggagggagctctcagtatctgcacagcccaggtgcaggacatgtgctgcccaggctgggttgctgtctgttgtttcaccctgcacagtgaagagaatggggggttaatgtgtcaggcatggcatgcgtgatttagaaccattcatgcctccaagtatttgaggcagctcctgggatccacatctgtgagcaaggaaactgaggcctggcttaaatcacacgtccaagaccagagttaggaacagggcacctgcctggacccaggttcacacctgtaagcatgtcgtgggtgtgggatatgccttagctctctgagcacgtggcagaaatttggggatctatcacccactaccgtaactgtgacaacgtctccacaggaggagcggcaaagtctaaattaaaagaacgtttcccgcagggggcgctcttttttggatctctctgcttggagatatctctgcctgtgtaggatcaaagcagagggaacctctgtgttttcaaataatgtttttcccctaaagcagcaccagtcctaattgagtaatagagtaacaagaagtagaaaggggaagctttagcagctgggccttcacctggtcttccaacaagccccaactcgacgagagccaaagcaagagacaccatttggaggggaagataagaagtcttcacaaggtcttttccggtgttctgctttttcctgggaggcggccttggcgtgtccctgagacctcctgtgatgctcacggctctggcgctgccatttttcttgggtgtcgtctggtggtgtctgcaaggccagctataatgtcagggctgtgctcgatagcacagaaaagacagcgtcctggaggagagcttgttggagcagatttacaagggagggtgtgggtgtcactcacagttcacgctacaggacaatccctttcactctgggagctgagtcccaggtgagagctaagttccaggcgagaccagggagtcgaggggactggatttctgcttctctcccaggagctgcgggctgggaaggggaaggaacagagctgaggtgtgacatcgcccccggtttcccctgttgcccaggttatagcttgggtggggctgacttcagaggcaacattagaaccttttaaaatacccttaatgatttacatgaattagaacaagaaggcagctgggtgtcgtggaaagcgagtgggatctgggttatgtcctcactgtgcctttttatgcacacaaagatttatctacccatgctatcaacttagtgtgtattatagtgaaatgccgtaaataatctcatgtcccctttatacagataagaaaaatttttcagggacattgagttaacttgataaagttctccagttatcaacctggtaattccagttctagaaaatggcaagaggtaaatgccaacagtgggtatttatataagaatgattatggatcagttaagcaagtcagtaaaaggaaatcgctagtgtgcataaggtgctattgaggcaatacctttatgcttttggtttataaagtaaaacattttaaatcttggtatttgtgctatgtctgcataataaaatatttcataattaaagtcatactttggaagattttttattatataagaaaatctctatattacaacattaagtgaaaacagtgggagaataaaatctaaaactacatatagagaccaaatcttataaacaatagattaaaaatactagtaaaaatagtataatgactatactagatttgctgtctctgtgtgtgaaattatgattaaatgatttctagtttatcctttctatattattccagatgtttcactattaacatcaattatatttataacaacagcagcaaaggtcaacgtgatttatatttttagaaaaccaggtattagtagttatggttatgtagcaaggctggctcaagaaatggatcagactctgagaggaaagacccacggttttgttgggtattcaccgtgtgctccccttgtaggtagaggtgatgggatggacctggcgttcactgcagctgcctgtctccacactgcacagcctgctttggaggacgcccagcctccccttgctggcctcctagcagtctcgtcagtttttcctgcaatgtgagtcactccctttgctgtagcctgggtgtacctggaaccagccaattgcatatccacagtcaggcggccactcagtctcctaccagagtttacaaagccagggtcctacaaacaccctcataagtgggcttattttggcccatcccatgaaagaagaggctgagtctgacaacagcaggagcagcagcaatgatcgcttattccgaggcctctatgtgcagggcacacctccactctcccgccgtgctgcgagccctttgagggcaggacccgtctgattcaacgctattgctccagcatagctggacagggcttcacactggacatgctcagtaaacttgagaacgtaaaacagatgatcgaattcctctgtactccagatgattttgctaaacagaattattacatatttaaaatacaggattatcactatttgaagatgaaattagacacttatataataaattaccccaacacttagtggcttaaaactatgcacatttgttacccacagggtctgggtagcagggatctgggagcagactggctggtactctggctcaggccttccaggagcacgcagctagtgctggctgaggcagctgtcacctgagggcttgtggaggcagcagggcaacgtccaggctctcttatgtggcctctggcaggaggcctcgggtgctagccacgtaggcccttcctcatgatgtggcatttggattctcccagaacaagtgactgagggagtggtgggagggaggttggtggagacagcagcgtagccccttcctgtgatctagtcttatgggttgtgctcgctcacttctgccatatacattaggagcaattcataaaatccagcccagacacaagactccacctcttgaagggagaggtattgatatggttctgctgtgtccccacccaaatctcaccttgaattgtagctcccataatcctgttggattatgttggaggagggaccctgtgggaggtaatttaatcgtggagatggttaccctcatgctttctcatgatagtgagttctcacgagatctgatggttttataaggggcttttccccttttgctcagcacttctccttcctgctgccgtgtgaagaaggacatatttccttccccttctgccatgattgtaagtttcctgaggcctccccagccatgctgaactgtgagtcaattaaacctcttttctttataaattacccagtattaggtatgtctttattagctgtgtgagaatggactaatacaggtatcaaagaatttgcggtcatcttttttaaaatcacaaaatttcaggagatttaattaataaagtgagactcaggtctaggcaggtaattagaggggcctccaagaaggaaacaaagactttgtctaacacactatggtctggagacagatctcctaggggccttgctcagctttttgcttacagcattgagctccagggattggctctgcttgccacagggtgatgtgccccatctctttatgttactgagggcagaagaagggtggatatctatagtttgcctgcatttcaggatccaagtcaagaaggagaagaaagaggaatggccctattgtgggagcctccatgatcgctactgcatttggcagtgatatatactcccttaacctttcctctgcaaagaaattgataatgatacttgcactagtaaatgtccacttctaaatgtctgtataaataaaacaagtatctaaactcattcttgccccataaaatgtctacactttaaaagtaaatcatgccaatctgctcatacaggcagaaactaaagagcctttaaatttgttttgcaaacaatcacatcaggatttgttctaatatactgatgcagtggacagatttatgatttttaggaagataggcacatattttgcagagagtaaaaatggaaattcagtgatagaaaatggaggtttgctccatgtaaggataggggctcatatgactcagtggaaaatagaggataatcgactctattatcctgcctttatgtggaattgcaataatgtccattcatattaaaaataaaattgaagactttcctaataatccagtcattcacaaataaatattgattgaatgccaaatatattccaggcaccagacactctcttaagcacttggatacagcagtgagcaacaaaaaaccttgccttccttggctttgaattccaatgcatagggaacaaaagcaaatgaatcagtaaaaattattacatgttatatggtgataaattataaaggaaaaaaatcagggaatgaatatagagggtcagggaaatggcttaaaattattaaaagcgtggccaagaggtcacgttgcaaagttcacatttgcccaaatagctaaatgaagcaagggagtgaaccaccacagccagctggaggaagagcattttgagaatacagaataagtgcaaaggccctggggtggtcggggagggtggtctgtgcaagagcatgacgaagtccatcgtggctgaggagtggtcagaagaacctgaccatgtgtgcctgttggttatttaaggattttggttttaaccaaagtgagctgggtggctgctggagggtgtgaaggaagagactcctaatctgagatggatctctgggatgaatggttgttggtgtttgagaagctattgcagtaatcgagtcaagaaatggtgctggcgtggccccgggtggcagtggtgggtgaaagcactgagagtgtgttctgcgaggagacttgccaagattgacccacagaccacatgtgggatattagggagcataacagtcaggtttctggcccagcccctgcaagtatagagtgccattgtttttagattgggaatgctgagaaaggaacaggtttagggttatgtttggtttgtaaagtttaagatgccattggatactgaaataaatgtatgaatctggagttcacagaaaaggtttcgattagattataatagagcaaaatcaacttccagagtagaagtgggagttttattttttatttatttattttattttttaccagaactgctatttttacaaactgaaagtcccttagaacatacactgaaaaaaaaatcccagttattctctgagtccttacatagaattgaagaccacctgcctgtttgtctttgcctgtttccttttcttctgttcttaactcctctccagctcctgaatagcaattttgtttctctctgcctcatgcaacagacttttctggatgattcgccccatcccccgtcatgccaagcctctgccccacttcatttctctttcagtgagtggagcctccgccgtctcccagacctattgttgcctggaccctctcaagcctaccccttcctctcctccctcccctcctttactccgtccctttccatggagccacactcggggcaagaccatctgctctggccttccgaggcttccgcactgctggcagatgctccccacgtcccctagaatggtttgtgatctttctctgtctggtcccaacatgcctttccagcctcctccctccccacgccagcagttaacccacgcatccatccaggagatttcccacacagactgcacataccgcacaggtgtgacctgctggtgatgatctgctttctctaaaatggactttcccttctgtctgcacttgctgatcaacaaaaagcctgctgggcctttaagacaggcctcaaaccacctctgctgtgaagcctgcccttcctcgtcaagaccccaaacgaggctcacctccccgtgaccgtgcagcgtgctgctggtcctgccaacggtgcccctgacggagctgtggttggtcctgtgtttacctcttcggcctttccacccctccagaggtccgcctcttgtctccaggtctttgtatctaactgaccagttggacactcaccaacctgaatgccatgtggtgttctggaaagcttcctctgtaatttccagttcagatcagttgttcatcctgtgcactccagtctcatcctgtgcttaattctaccacaacaaacaacgcagtattaaaattgtctgtgcagctttctctgcagtctgaaagacctcgaagagaacagacctgccttatttactgtgcgagtatccagctagagcctggagctcagtaaatatctgtgatttcactctttctctttctccttccatcccttcccctgtcctcctctccctttcttctttctttccttctttctttcagcacacatcagtacaattccacacaatggaaagagaagagtgaacaaggcaggacatttagaagggaaagtggaggagcaaagtgaggaaatcttatcagaaaaggggtgatcagcaatgtttaatgttgtcacaggcaagaaatatgcaggcaaaaaaatcctttacattctgtaactaggatgttgcatggagatttatataaagagtgttgggctgggcacagtggctcatgcctgtaatcccagccctctgggaggctgaggcgggcggatcacctgaggtcaggagttgtagacaagcctggtcaacatggtgaaaccccatctctaccaaaaatacaaaaattagctgggcactgtggcgggcgcatgtaatcccagcttctcgggaggctgaggtgagagaatcacttgaacctgggaggcagaggtttcagtgagccgagatggcgccattgcactccagcctgggcaacaagagcaaaactccatactccatctcaaaaaaaaaaaaaaaaaaaaaaaagaatgttaacacttcttgctcctaccgtcttactcatttcttccttcgtcactcattcattcagtaaacattggatttctatttcctgcctcctctaagattttctaggcacttggacctcaaagatgaagctattctcacacgcacagattgtcaggactttgaggctttatgggtgatgggcctttacacattgtactgtctccataaagcccctccttagcttccatttttttttcttttgagacagagttccactcttgttgcccaggctggagtgcaatgaatggcacagtctcggctcactgcaacctttgcctcctgggttcaagcgattctcccgcctcagcctcctgagtagctgggattacaggcacacaccaatacgcccagctaatttttgtatttttgtagacatggggtttcaccatgttggccaggctggtctcagactcctgacctcaggtaatccgcccgcctcagcctcccaaagtgctgggattacaggcatgagccactgtgcccagccaagcccctttttagtttctgtggggacccctcattcagccacagacttgccccttcaatggccacttcattcttccatgtgcgtttttccttgttctcaagttgtctcctcagcttgagtgtgaaaaacatttcatgctttttagtatcatccttaggataagtctcatatctgtgcactttcatattgatcaaaaaaatcacaagaggataactgaatggacaactataaaacctcctgtttctctatttcatgtcagacaaccctagctcccttagctttgcttccagctcctttttcctgatgctttaatcattgctgttcctctcttaatgtgcatcatgcacactatagttctctaaaatcaggccactttaagccatccacaggattttatggaatactaatcagtgtcatgttccactcaacatgtgatcggattttgagagcagtgaacagggtgtcctctgagggcctggggtaatacccccattctgaatcacaaaggccagccccatggggtcagagggttggcctggttagccttgtggagcctgtgttctccaaacagacatttaattactgtccccaatgagtaccctgatcacaatacttattgctccaatggggtctgtgggtggggattgcaaaggggaaggttgccctgcttagctcaaggggagcatctcctgagaaagctgattccgacagaagtgcagtcaactcagcaagcctcttccttctgtcctgttcctaaaaccatctgctcattgcaggaagcgactccattccgtcagccatactgatggcattaggttctcctaaaacatctgggttttccttgtgggagaaaatcctgcagtgaatttagatgttggtggacctctaagcaagggcctcattgagtataggaggggaaattataaatgtcaaattataagtgtgcaaattatacaagtgcacccctgcttggccttgcagggcaccactggccagctcccccctctccaatttttcttctgttgccgtgatggtgaatgttagttgtcaacttgattggattgaaggatgcctagatagctggtaatgtgtgatttctgggtgtgtcggtgagggtgctgccagaggagactgacgtttgagtcagtggactgggagaggaagacccatcctcagtgtgggtgggcaccatcccatcggctgccagtgcaggcagaacaaagcaggcagaagaaggtaagataagcttactcgctggttcttctggcttcttgctttatcctgtgctggatgcttctttcagcttctcctgcccttggacatcagactcccggttcctccgcctttggactctggcacttatgctagtggtttgccgggggctctccagcctctggccacagtctgaaggctgcattgtcggcttccctggttttgaggcttttggacttggactgagccactaccggcttctctcttccccagcttgcagatggcctatggtgggacttcacgtcgtgagcatgtgagacaattctccctaataagctccgtttcatatacacatacatcccacagatctgtccctctggagattcctgaccaatacggttgcccacccttctttgtctcttctttgccacgttcacttctacgtggcctcacggaacccacgtggccttgcctttctggaatcgcagtctcctccatgtggagatgcgtcacctgtagctgatggataatcacttggaaatgcagctgccccggacgggaaggggttgtgcatttctcatattgtttttggctagaccttgagaaattttgcttcctggacaacttagtcatattttatgaagatcctttgtcagtggctagaaaattggacatgtatgatatatggctggggaggactaatgggctcttccttcaacactctgtcaaagtggggccagtgcccatggtggaacgtgctttagtaagatgagagaaggtgttttcatgattaacaaggcatggcattcgtatttcaaagatcacatgacatatcaaaacagtctgctaccgtgtatttatttggtggcatggacatgggacatgtggtattttctcagggacccttcggccctggacctgtgctgtgcaggcatctgcctgtacacactgcagctgttaacctgtgcataacaaacagccaatgtaagatcagatttgaggctgggagtggtggcacacctctgtgtgtgtgcttacataacatacactcaatgtaagatcagatttgaggctgggagtggtggcacacctctatgtgtgtgcttacgtaacaaacactcagtgtaagatcaggtttgaggctgggagtcgtggcatacctctgtgtgtgtgcctacataacaaacactcagtgtaagattaggtttgaggctgggagtggtggcacacctctgtgtgtgtgcttacataacaaacactcagtgtaagatcaggtttgaggctgggagtggtggcacacgcctgcggtcccagctactccagaggctgaggtgggaggacgcttaagctcaggaggtcaaggctgcactgagccatgatttcaccactgcactccagcctgggtgatagagtgagactctgtctaaaaaacaaaaccaaaaaaacataagatcgaatttgactcgaccgtttgtccctctgacacgtaatctaagatgtcagaagtatttgtgtcaaagaaggcaagtgggagagaccgggcctgaggtgatgctgtgttccttctttgatgacatcattaacgaggagagggatggccaaaagaatccaaaatgaaaagtgtgctgataacagaaccaatcacaggcacaactagcctgggattccaggcctgccgaggctgctcactgcggagcctgtgtctgattctgtgtgaccagagccttggctgcaaataacgaccagcctttcctcatcacccaccagcaggcacccaccacagccctgtttgaggtcctttgaactcacagttttagaaaaggtcagtagtcaggtgatatggtttagctgtgtgcccacccaaatctcatctgaattgtagctcccataattcccaagtgtcctgggagggacacagtgggaggtaatcgattcatgagggtgggtctttcctgtgctgttctcatgagaatgaatagggcttacaagagctgatggtttataaaggggagttcccctgcacttgctgtctttgtctgctgccgtggaagacgtgcctttacttctcctttgccttctgccgtgattgtgaggcctccccagccatgtggaactgtgagtccattaaacctctttcctttataaattacccagtcttgggtatgtctttattagcagcatgagaacagactgatgcatcaggataagtccacattgcaggctcttcagggcatggccccgactcgctttcccatctcacttttggcctgtccctcatgtgtaccctgggcccagctgtgacctatggaacggtataactcccctgaatacactgtgctcccacagattatgtgcctgcccactccatctccacagcccccatggagaggagagaaaggggtggcagactctgcctatgcgcccttgtttcttactcagagataaaagttcattcagaaaacatcttgagttcccccaggctccgttacttccttctttgctcccatagcattacctggtgaaaagtgcttctgttgcaaaacttatgttcatgtgtctgcctcacttctccatgaggggctcagtttcttaagaggaggaacagaaaggctaggtctggtctctgcatctccaaccgctaggccaggcgttatatccttggtgcgtgtttatagaatgtgatggtagacatggagtgtggtggggtgagcagagcagatgtgattgacattctggtgaaaaggctgagcaaacacaggacccactgctctgtccctgcactgggctgcgtgctggagattcagtggccactcatgctgctgctgtgttcttgtggaggtaagaggcagtgggtagaggagcaacaggtgatatgtgaatgctcctgactttgtaggaaatgggaaaggggctgatgggtgggggtgcacgtgggtgaaggaggtctgggaaggtgtctctcctgagaaggcagcagctggtctgggaatgaagggtgcgatggagctcactgacaacccaggcacaggtgagagcaggtgcacagtccctggagagaaaagaggctgaaaggctggaggaaaagttgagacccatgtggggagggacggatgaaggttcagatcaggggcctccggaagtgagggaaggagcaacgcactgacgctgagtgctttcaagcaggggagtgcagagaatggatttcaccttgaaaagtgaatgtggaccataacaagtgttggcgaggatatggagagaagggaaccctcacacagtgttagagggaatgtgagttttacagccatatggaaaatagtgtggaggttccttaaaaaaaaaatccaaaatagaattactggatgatccagcaatcccacttctgggtttagaaccaaaggaactgaaatcagcttgtcaaagagacatctgcactcccatgctcactgcagcactgttctggatggccaggatatggaaacattccctgtgctcatccacagatgaatggataagaaacgtgtggtgtatgtacacaatggaatactatgcagccttaaaaaagcaggagagtctgtcaattgtgacaacatgaatgaacctggaggacattgtgttaaatgaaataagccaggcacagaaagacaaataccacattatgtcacttgtgtagaatcttaaaaagtcaaaattacagaggcagagactagctcagggatggttgggggtgggttggggagatgttggtacaaggatataaaatttcattggacaggaggcataagtttttgagatcaattgcacaacatggtgactatatttaataatgtaaagtatgtttcagaaattgctgagagtagattttaaatatttgtaccacacacccacaaacataagtctgtgaggtgatatatatgttaactagcttgatataagcattccatatgtgtatatgtatatcaaaacatcataatggaccccatgaatatatgtaattattatttgtcagttttaaacattttttttaaatgaacatggaggttggggaaccttaccagggttcttttggtctccgccttgcctggggcccagaagtgctggtgaggggttgctccctactctggagctctggatgctgatcagagaccctccatgcctggtgacatctcagactcagtgaacagcctcaggggcccttcacaaaactgggctgtcagggccacctggagctcagagtggtaatttggttccatttgaacttcaattttcgttgctttgaaatctcattcagttgaatttaataacaaataaataattcatggggactggacaatgaaaggaaaatttaaaaatgtgttcacccaaatatataaaggggcaccttgtccctcagccctgttctctaccttcttttctcagctggcttctgggcagattcatggcgccaaaggatgatgcgttaactctctcagggtgctgagggttctctcatcatgagacttctgtgggttagggactgggcaagaggtgagcaagtatcccacctctggcaggccagcctctcagccaccaatttgctaagtggcccaccggtcatctctgagccttgtttccttgcttgtaaaatgcagaaatctttagtaaaccaattgatgtaggcaaatgtcatgaatggatacacagtcatctcagggaatttacatggtgttaaagtatcactccagggatcatctgctggttgcaaggggagaaatgtgactttatcctggagaacaccgatgctctccaccttatcaattcctgcatccctaacactgggacaagcagatatccttccatgccccatgcggtgcctagcatcacctgtgaggtaatgccacaaacttgtgagctgaacttaatcaagctcttaggtctaactttcagtgcgtaacaaacacaggctgcagagcatccagctaatgcacaccaggaggaaacagccagacaaatccagaaggtggaaacgtggaggcaacaactcacccattccttccagcaagccagcaatgtgtggtgggctggggagccactggggcggacaggttctaagttgaaatatacgttaccaccaaccaagggcaattcctgggcctcggctaaatccttacctatacaaaccagctataccagtcactttagagtaattggggaagttattacatgagattagaaaattgtattcattttttaagtgtgaaaatgttctttttcctttttaaaaaagcttctgttttaggttcagtggcacatatgcaggtttgttacatagagaagcttatgtcatgggggtttgttgaacagactcttcttaattatacaggaaaacgtctagagcttgtggtctctcttctttagcgttgcttactgagattttttaaaaagatgcatcctgaatgatttcgaggcataatgttttggtacctgtatgcaattgaaataatttttaaaatagatatggagtaaatatgaaaactaacaattttcaaaattttaatgaggagcatatgaaaattatactctagtatgctgttacttttcttttctttttttcttttttcttttttcttttttgagacagtcttgctctgttgcccaggctggactgctgtggcacaatctcagttcattgcaacctctgcctcccaggttcaagtgattttcctgtctcagcctcctgagtagctgggattatggggcacccaccaccatgcccagctaatttttgtatttttagtagagatagggtttcaccatgttggccaggctggtctggaactcctgacctcaagtgatccacccgcctcagcctcccaaaatgctgggattacaggcgtgagccaccgcgcctggccgctgttaattttctaatctttaaaaataataatagtttttttaaaaagctgctcacaaatattttattgatgatgtgtgcatttttttttcctctggtaggacataattctccctgagaaggggaaagacagtaagaattttgtgagttgcataatagtccattgattaccctttgtcccccagtggagggcactaaacccctgaagaagcaggcccctgtgtgggcgtgttatgattgtagaacaaggagaggggaccctccagtactcagtgtctttagtgggtggggcgggggcttcaaggcagtagcctcagatacctgcggggcccatgcagggaaccctaattggggtgcagggtgggggagcaacagaatgcaaaatagctcttagtaccttacctaaatattggttgctagattttttcattgactggaagctttcatttggctctggatagaagtgtgggcagtcacacaagtcaaggtaagaggggtggaaactggtttttgctggtgcttcctaacatttgtcaactgtggctttcaggctaccaatgggtggggagttttgtgcgagaaaatggaccacatttgcatcctggtgttctccaaatgatgttaaatgcagaaacattcaatgcaatgagtttgttcaattccatccaactaaaaattgtgtttgtgctattagtgcctaccctctgatcagtcttgtactaggtaggaaacatggtgcttaccctttactaaggagttgtgttacatgaaacagaaaacactatgactgaatcaaaaagaagcatcactctgcttgggtagtcagggaagaatcttgatttcccctggaatctggtacttacctcgcggtgaatatacaataacagccagagttttaaaatagacaagaaggacagaaatcagagagaaaaacacagacacatcagaccccttatcataaggtacaaacaatagagcagaagggagaccacaaacttccattctttatgggatgagcgagaaaggggatggaggctttggcaatgttgaatgggttttccacaggaacagccagccccaactgatgtgtagtgatttcctaggaagtttgcaaacctcatcccaccaagaggaaatgggtcgggagttctccatcatctggaggtcacagagcagacagaccatggcccaggacaagatctagaagttgttattttattcaaagtcagaaaaccttccagggtctggggatcagtgtctggatagaagagaaaatacaagagaaagcaagaggttaatgtgggctgaaggcttagaatgagcagttttaggataaaggatagttaggaaaggatgggggatggagaggagggtgcatgtaaggcaggacaaaccaaagagaaagacctgaatgtatctgctgtgtctgtgggacatagggaggttctgttcattctgaatgggggcttcgagctcaagcctaaaaatccatcctttcaaataggtacagaaagaagggctttgacaagtaccatgggctgtgcttgattgaaaggacagacacattcagttgttgttatttgtgattattgtcagctccatcattgatggcactgtgcattttttgaagtaggtctctcccatcaaactgccaggattccagtgatcagagagcaggtcttcagtagcacaggctggattgggtggtgcccactcccggcttgaccacttagctctgtggtgccttggtatcctcatctgtaacgtggggataataatggtgtctgtctcataagaatgttttgagaaacaaatgagaaaacccaagtcaagctcttctagaagtgcatggcagatagtaaacagtcaatcaacattatcagtcctatcaccggtgtgggtactgttgagatacctgtgagagtaaatcatgatttatgccaatggttaatggaaaatatttattttagttattttcttatctgggtagtgccagatgggataataaaaatgaaaacaggcagggtttcgtgtgtgtgtgtgtgtgtgtgtgtgtgtgtgtgtgtgttgctttgtttgcaagcatgatttagttgaaattagatgtctcttctgatctataatctctttgtcttcagactgaaacctgaaatcccatctgaatatggctgaagcaaatctgcacacagtgtcttgatgggaggatatgactaactcttagattggaattgtgttggtgcgtaggcaggttctattattaggggtaatgttaccacattattaaaatatttttaggcataagacaggattctttccttcacagataaatggtgaaacacacatattcctaatttttaaattttgatcaaaattttattaaggccaaaatgggcagagactgggtaacagaagccatattttccaatttgccctcctttactctcccagattctccttgcatgttggctggagtggatcacgaagggtaggaagctgagaaaggtggaataattggaatgttctgcaactctgaagccaaacaaacttaggttttggatgacgtggacagtggatatcatatcacctgttatggtgaaaccatcaccaatacttactttacaattcccatcacacaccccagtgactttctgtgaaagagagatcagatatctactgtatttagatcaactattacattatcaacagtggaggaataaggaaatctaggatgctgtttagtagcaaggaatgcatcaacaatagataaaaggtggccaggcatggtggctcacacctttaatcccagtattttgggaggctgaggcgggtggatcatttgaggccagaagttcgagaccagcctggccaacatggtgaaaccctgtctctactaaaaatacaaatattagccaggcgtggtggcacatgcctgtaaccccagctcctcaggaggctgagggaggagacttgcttgaatccaggaggcagaggttgcagtgaactgagattatgctgctgcactcctgcttgggcaacagagtgagactccatctcaaaaaaagaaaaaaaaaaggaatctctcagtaggtactaaataaaacagggaaaaaaacataactaaacataactacaaactttcttttctttcttttttttgtgataagaacacttaacatgagatctaccctctccataaatgtttaagtcttgttaactgaaagcacaataggatacagcaaatatctagaacttatttcattttgcacaactgaaactttgtacccatggaacgcctcccatttccccttctcccaagcccctggcaagcacctctctactctctgtacaagtctgcctgctttaggaagtggaaccatgtagggtttatccttctgtggttggttcatttcacttaccataacatcctgtaggttcagtcatgtttttgcatatggcaggattttctgctgtattaaggctaaataatacttgatggtatatatgtgccacattttctttatccattcgtctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactgtattccaaagtggctataccattttgcattccccccaacaatgtacaaggattctgatttctacacatccttgtcaacatttgttttcctacatatatatatatatatatacacacacacacacacacatacacacaacacacacacctacatacatatagatatataatagcaaccctcataggtgtgaggtgatacctctttgtggttttgatttcatttccctgatggttaatgatgttgaacatctttttatgtgcctgttggccatttgcatgttttagttgaagaaatgccttttcaagatttttgcttttgtttcttgtgcttttggtgtcatatccaagaagtcattgcctgggccaatgtcatgaagcatttcccccatgccttcttttgggagttttacaatgtcaggtattatgtttaagtctttaatacattttgagtcgttttttatgtacagcataagataagagttcagttctcttgtatggatatccagttttcccagcaccatttttggaagagactgttattttcccatcatgtattattggcactaactataatggtgaaaagttaaacgcttttcctttaagatcaggaacaagacaaggacgcccacagtcactgcttctattcagcatagtagtggaagtccttgccagggcaattaggcaagagaaagaaactaaaggcatctaaatgagaaaaagataaaattatttctatttgcggatgacatgatcttatgtgtagacaacccaaactttcttatcttcacagaatattttgcaagagttgagctcctagaaaatgagcttagatcatttctcccctctggccagtaacaagatgctcctacactgagcttcatttagcacagccctggacacaccaccaggcactcagcaaacatcagacaatttccagttcaatggaaaattctcagttatccatggcagaatcatggccctgtcatgcactggctgagtttgcttgaggaagctgcttaagctttctgactcttggttttgttatctgcaaaaggggaatagcagtgtctataccacagggataatatgaaggctaaatgagatcctgtaaagcaatctttccaagtcctgagcttgacacaataataaaaactaacctttatttaattattgagggtggaggaaggaggataaagaacagaaccaaagaacagaagttatttcccagtgaacttaaacaattcatgagttttctcatcttaagcagggaggccttaactgcattgtctcatgcctttaaccagtgagagtcagagagagctaaggcacatccaactccgttgctcaactcccaggcacccagcaacaggtatagagcattgggagctgcactctccatactgatgttataattaatcttccacctcagtcaaccgatcatagagttccacttttggaagtgttccaacctgcacccaggaggcttctgcagtcttttttgctgccagaatgtcctccctgatttacacctgacttcggcaacatctgagcattcatatctgtgctacatgctggctgtagccatgggtctcattctaaaacatccttgccttcaaatacaggcatgaggcaggagtggaggaaggagaggtaagaaactattcatcggccgcctcatgggcatgctgacggcaagagttatgaggtgtaaacctgggttcacatcttgttttcttctccaggtgagggtacttcatagagctcagaagaaactcaaggaccagctctctcgggctgcccctgtaatatggcccactgagggcaggttcctggctgcccttggaacagtgctgcagtcatcaggtggtgtgaaagacaaatgcctttgtgccctcaaaggcaaccagtatatatgggaggtgctgtccccccttctgccactcatcagctcatggtaaacagaggccacttaggcaccactcaaggcattgaccagtctgagtcctaattatagggtcctacttatagccattatgaacctcaaagccaaacaagatgaattttgtcaaaggactcctcctggctttagttgaacagaatcatcagactaggaagccattagtgaccttcgtgagtttccagatcttcattctcatggctcttatcagagatttgctctgaggtgatagtgttatagggccctgatgcaaaaagcccagtgcagattggcttacctgctgctgcatcttgattgtccatgggtggggtctactcctgaggtcttgggattgaaaaagttcacacggactgtaaatcctgccattgctactgatgacacttgtacttgttgcggtgtgtccattgtagtgggaagagctctgctcttagagtgttatacagcctatagggtttggattcttcacatttggttggttgactttgagtctcagcactttcaattgtaaggtggggacagtacaaacttacagaagttattgtgaatacacaaccatccaagtaattacacctgcagagctgactagtttactttcttgcttgctgtctggtaaaactcttgccaatcatagacaaacgatcaatgcataaggtaacctcatttgagagttcaagttctgaacagaagaaaaggatctcattcctgttatgaacagcttagttataaagtcaaatgtaaaatcaaatatgtgtttctgtggcaaatggttaaattcttaccttttacaaaacattcagtagtcacaaggtctttacacacccactgcttatccatcatatttatatatggtgtgcctgttaggtaagacatacacactttggttagttacttgaatagatcataaaattaagtctaggactatgttttctgctttatttaaattttctcatccaaggaaaaatttcataaagagtggttaaatgaatgaatgaatggacatttactgtcttgaataaaacctttttatataacttagcttgttttgcaaaagaataaaacactgggttcaaactctttatttttcattgatctttagaaatcagggtccctcttttgaatacaccccttgctcaaggaaaggaaccatttatgttctggccttgattactgcacaatggcttttactacatttgatttgcagcagttcatttgtgattaaattttctaattctcccagaaagtcattgaacaagcaaacagtttactttccccaataaaacaaaacctaaagtatttggtctttaataaatgttcaaaaattattttctcagtgtgtgttcgagatataaatatcccttcatctcaaccgtcttttaaatatttgaccaatctacctttacagagtagttgtttctccttatgtcatttctgatctatctttcttgaatttttctttgcttagtttttaatcaagccaaatgtttgtttaatcagatacctcaattagtcaagacctgtctcttttatcagaaggtgaatttagagaacaattctaaaacatagggtaatacaatttttttaaaagaaaaataaccaaattctaagctcagcttggtcccagggcaaattcactcctcattcttaattcttcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattttggagtgggtcttgtgaatttgacagtttaatagtcacgtggacgcacactgttgtttgcaggaggggccatgaacccctgccctgaatgaaagggaaatacttatgtccgtggtaaccagggccagtggcagccaggaagccaagacctggcctccgctgccactgctcatacaaaccaaacgtgtacatcacgtatgggatataggagaagcacatctgaagggctatggcagaagtggaaagaaggcaaaactcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctattacctctgattctgcttctctaaaataaaagctgaccgactggttggaataataatacatataccacctggcattttacagttttacatcatctcaggtgatacaaccaggctatgatgcagtcatgtcaccatactctttaccagatgagatgcaaactcagaaatattaggaaatgtagctgtgatggattgggctataatcaacttgtgatgtgggagtttctcagaatctctttccctatatacatatggttccgagctagagctggccacagtgaagccatgagacttgggaggtgaatgaaggaggggccattatgctctggaggttttcatcgtgtaactgaacacaggtccggatgctcaccgcctgcagaatccagttaacaagaatgagttctggtagaaagaaagtgactttattcactcaaactagtaaagaacaagtggccgggttcccatccaaagcaaccacttcaatttggcagagaggaagacaggggtttaaaaaaggaaatcttgacgtgaaaagcttgcaagaattgtgctgagtacaacgtctgtgtaccttgttctggtggctatcttgggtcccagtttacctggatctcgggctggtgtcatctcaacaatggtgaggctgttgactcgccaccttgaagtcatctctggaactttgcaggtgggtctccagacttggttcatgtgtctcaagattacccccaggagcttctaaaaagggacataattagatgctagcatacaggtagatgaatgtgaagggagtatagatggtgagaaagggagggatgtggagttcattttaagacaaagagggaaaggcttctgcaatttgcttcaaggttatatcttgaaacgcacgagaaataagtaaaaagtttaaaatgcattttgcagttaaactgcccagttacaattggtcagaagtggtgagagacacagtggagctgacacagggtgcaagtttgtcttcactcttccttacccctgtctttatttcccgatttccagccctgctgacttgcagtgagtccagggccaccatgcgatgctgtaccccactcgacagacctttacttccatagcacctcacatcattcctgtaaaaggttgttactctataatattccaaatattgagagtttcactctcaagtttgaactctgactgacacattacctgtggtctccaggtgggaggtgatgtgttttttacactttataatttttttttatttttatcactcactatacttgactgtgttatgatttctatattcgtcattcttcctgcatcattttctctcttctttttttttttttctgagacagagtctcgctctgtagcccaggctggagtgcagtggtgtgatctcagctcactgcaagctccccctcatgggttcacgccattctcctgcctcagcctcctgagtagctgggaatacaggtgtccgccaccatgcccagctaattttttttatttttagtagagacggggtttcaccatgttagccaggatggtcttgatctcttgacctcgtgatccgcccgcctcagcctcccaaagtgctgggataacaggcttgagccaccgcgcccagccatctatgttcatttcaaaggggtcttccttaatgatagtgcccttgaaccaaaaattaaagagttgattaaagtagtagaaaatggtcatctatacaagtttcatgatttataagaactatggaaattgctccttagaaaatagctttctaaacatgaaaatacagttgattagaaacagtacacatgaggaactctggtttcatgcaaagttgaaggaaattcttgtgaaattaaaaatgcacccagaacagttgatgaagtctagtccaatgaaagggttttcaactgtttgatttccatcttgtcaaagaatcaacttttggttttggtgaatgaagtggtttggctgtttccccacccagatctcactttgaattgtaataatccccacaggtcaagggcgggaccaggtggagacaattgaatcctggggctggtttcccccatgctgttcttgtggcaatgagttctcaggagatctgatggttttctaaggggctttcccctttgctcgactctcatgccctctcttgctgctctgtgaaggggcgccttcctccataactgtaagtttcctgagtccctcccagccatgtggaactgtgagtctgttaaacccgttttctttataaattaaccagtctcaggtatttcttcatagcagcatgagaacggactaatccggtaatattctccactgtttttctattctctacgttatttacttctgctctattatttattgtttccttccctctgcttgctttgggtttagcttgctcttcttttgctagtttcgtaaggcagagtgtaggttgtggattcgagatctttcttccttcttaatataaatgtttacggctataattttccttccaattactgtttttattgcattccctaagttctggtatgttgtgtggtatttttgtttttattcagctcaaagtatttttgtgtttcccttgtggtttcctccttaatactttggtaatttatcagggtgtttaatttccaaatattcttgtgtattttccagttttccatctgttactgatttctaaattcattctgttgtgatcagaaaaagacactttgtgtgagttgatttcaaccttttaaaaattatgaagacttgttttgtgacctcacatacagtccattttagagaatgtttcaggtgcactggggggacatgtgtattctgctgggcttggcagagtctaataatccctaatatacctcgcttctaatgtaggtgttcccaccagagcatgccagtgtcatgtccacaataacaaacaaaaattcttttttttctttttctaaagccatattgtagattcccagttcaactataatatatattattttagctatctatttaaagtgtcacatcatcctagggacctttcaacggactgactacatttctcacaattatagtaattactgaaaataaacacatgagactattctcttcaactaaaatatcatcttattttacatttagtacaattgagaaatttgcatgtaaagctaaggaaggacacagctttagaaacaatggactcatttctctccagacctatgtgaaagttggtttgacagtaattaccttatgggagcccaaagttatgaaataaggatgaggaatgattgttcccatcacagacggatcaccacatcatcccctgtgcatttgcatgttgtgtactgatcagaggtggcgtggtgtggaggggcggcagtggtgacgtggaaatgtaaagaatttcgtgtactgaggatccagttaaaaatcacactggaaagagaaccacatatagtcaaggaaagaagaagtggcctacaaacctgtgatatgatcttgaaatgacttattttaacaagcatacctcccatctattatataaaataaaccgaagttactagaaagagatgggggttaaattccctatcacttactagctgagtgactttgagcctgtttcctagtctctgtgagcttgtgtttcttcatgtgggtaatagaagtcataataatactcactttagcaatttgctgtaataattggcaacaatatcttgaagcacagattataatgtccagtatgtaatagccctcttgtatgtcgctgtattctttctactgtccatagttctttaggttattagactgacttatgaactttgagcgctggtcatcagacctacttcacatggagcctcgagacccctccctcgaattatcagacccttccccctctggccatcatcctcctccctctgatcatcactgtgcgccctttgaccatcaccctcttccctctggcatcagactctcctccctctgcccatcctcctcctccctctgaccatcaggcccgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacattggggttatttataacaggggaaaatgaggtctccagggaaacaaaccataataaagaatatgaactcccgcagaccgaattgccttcaacgatcctcaaagacttttgtgtttgaccaatatcaattaattacatcagtaaataactgcctgagccttgtacttctgtcctcccaagatccagaatgacttctgctttcaaaatgaatttcagggctttctttgaagcagtcttgtaaagttgttatatttagtttaaattcaattaaagctcaatctgaaagctctttctgaagcatttgttccacatttacatgaaggtatttgctcttaaaattgttaggggtatagctcatttctagtaataataagtggtatttcataaaccaggatacatgatcatttacttcctgatagcttgcttctcccagatctaattctattcttccttgagggctgttggtgccagtgccagggctgcaaacatcagggttagactggagagtgacccgtgtgctccttcacccctgggtggggcctctgtgcttatcagtaggctagcaccaggtgcaggagacagatgtgccgcctgctcacagggcttacctgggacaaatgtgccgctcgctcacggggcttacctggggacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacctgggatagatgtgccacccactcactatgattacctggggacagatgtgctgtctgctcacagggcttacctgggaatgaagttccactcctccacttgcttagttcttgtttatttgtctctcccaccatttcaagtctttgctatcatcatgaagaaatatgcagggtgctggctgtgcagtgatgagctgggagaaaatgatctgtgacagagctggtagttaaggaagaatcccttggctgaagcagagtgtaagggatgagaagccaaatgggtggagagcgggagcaggggaggagggtgagagcatgagagggacactgcatctccagaggctggagaggggcaggggtgcagcttgtcatgggacatgtaagagggccagggactgatgcagagagggacaggaagcagcctgcaccggcactgtgggagcaggcagatgggaacgtggacagggagttagtgttttctcctaaatgccatggaagacattgatgtattttcaacagtgcagatagaaagcagtaaatggtttcaaaaatatcccaaacaatacaatatatagaatttcctgatggatttgacttgcaaacagagtggaagaaagaagtatgatggcatctatgctttgtgctttttgagcaattggttgaatatggacaccattttctgtcactgagaagactcagggaagggcgggaggatgggggtaagtgtgcagggccggtgaaactgggagatccgtgagatgcccaagtggcaacgtcagctctgaggaaatgacactcagagacatggcctggactcgaaataaaatgtgggagtagttagcacacagattatgttccgaacctggaaatgaatgaccacacctaggaagaaaaagcaggaaaagagaggagagggcccttagagatcccaacagagggggctgaggtgtgtgtgtgtggtgagttggaggacagccagaagaaaagatgacgttccaacagctgagatgcagtcagggcgcagcccattggtatgcagcgtggaggtctttggagacatcactaggaaccgtttactaaaatgtcactaggagcagtgcctgtagaaaccagatcagggcacacgaaagggtaaatgggagacgagggagacatgacactctgctgtgtggactcagaaacctttctgcaaagagaagccaggaacacagcaggatgcaaactaagacgtgaaaactcattcttcgaagtcctttcagagtcctacctgcttctgtttatataccgcctacatttctgaaaattctagtgtaaaacaaacatgtatatattaaattacgttccttttacttttgttaaataaaaagtagtcgcattagagaagagcaaagctaagaaacataatgaaatgatgtgtaaggatcctaacatgaccactaaagagcaatgcacctgagtgtgaacgcatcaaacgcttccaggcctggcagtcaatccatgtgccatggcctcttacaaggaagtcatcgttctaacaccccatcggtagggcacaggctttggttattttatcagtgcacaaaaatgaattcacactgttactggctttcttctgctggtgcacattaggtgtgatggctccttgggcttacggatgacccctgtggctagaggcgagggtgaagataatgggttcacattgcacagattaaagcagagactctattgtgttcagaagaacctagagttaatgggccacaaacagatcatcttctggcctccctagcagagccctcggttgcctcctgacacagtccatttccactttgacacaagtgtttgccagctttgtggtacctgattattagggtcctcttagttctgtgattgctccaggaattcggtaaaaattgtcatctggaagaaccaaattgcagttcttaactgggtagaattcaggctcttcaattcttgattccattcattacgtgctcactgtaagaagtggtacctccttgggatattgaatcagaaaggtattagagaaagggctattcatggtgtagggatctttggacttgaaggtgaaatttcaaacatcttcaatattcattttggttctgggagaggtaggaaaactgtctagaaatggtccatttataatcatatatgtgaatagaacttagcattttggttggttggttggttaaatgtgtgattgtgaaatagggctatgatgagttgacataaggggaaatcgacctttaagtagggtgaccatataattttttatccaaatggggtcatgagagagggaagagtggtgctattaacattcacattgagacagatgaaaacattcacgtccagacagggaaacctggatgtgctgtcatcttatgagggcttgtcatttgctaggaacaatttggtggtcgtttttccttacacaacaaggagagaccaggagcctgccctcttggtagatcagctaaacatgtccacaggattttgcttccaagatgaacatgggtgtagctttcaggagtgtccatcgagcatcacgattcgaaacctgaattttcaggggcttctctgtcttgtcaccttcctttgctgcatgcttcagtctctgcttgaatttgcacctggaaatggggttgaaatacatttggtgcagaacgatagcatttcaaacctgtctaaacagtttgcagacattaaaaaggatttgtatgccaagaaggaggcccctagctcatggggccagccccagtttgccttccgaatatactcattttgctgccgttaaagactttctgtgtaatttgagtcaaaatatccctattttctagttataccgattttcttcacttctaaaccccaagccaccataacacttttttcaaagtctgttttgctcttcccaccccttccagctccttgggggatttcaagatgggattgtggagcatagttaaatccatcgtaattacattcagtcagctgtatcccctcttcttctttgcctttgggatttcactactttaaaaaagtattctctgttgctgaacaattaaacataacgctaaccttgcagtcagattagccataatgaatatggtgtgggcatttgatactaagttacgtcattttaagcaattaaattaatatctcaaagtcaaaaagctaattccaatgattgctgtagacattttaagaaaatattttccaagagaaaagggatatcaaaatataaccatttttcttttgccaagaatacattgcatttgttttaggtacagataagaggcattttaggtatagattaaaatctgtggtgaggaaatgtagtcaagaaaagggctttacttgcactggagaagacttcccctcatgcacggccctcactaacttggagctgagctgcttgctgtacacgagctgtgcatccaagtgagcctctgtagtccagcccaggactgctatctgctgttgcctccggctttctggtcatgctgggggagttggggtaaacaggagcagcatctcacacacacacacacacacacacacacacacacacagacacacacacacacacagacacacacacacacacacacacacaaaacagctctttctgaggttgggaaggaatcattctttccaatggcatcgttgcccagcgttggccagactgtgatctgtttctgtccaagaatgaagacagctttccctttctaaagctgttctcagctgttccctcatttcacaagctgctttccagctctgatgtctgtggttgctgtagcagcaggctaagccacacctgacccacagaaggacatgaggttggttctacctcacagagagaagctgaaatctttgttcctattaacacaaagataaggggctcggaagtgtgcctgagcgaatgggactgacagtagcaatgacggtggaagaaagcccaagaacgtctccacagagggatgcctggcaacacaggagcaggcccacatggccagcatctctgaggtttaccttacccgcaacaggcacagctggcctctctgccccatgcatgacttgccacatccctgaaatacgaattgcatgaattttatgctggaacaagctgcagagtgatcagtcacatttgcagccctgtggactatggctattggaccgtacaattaaaattaagtttgacattaaatctaaaacaaaattttttgaaaataaaaaggctagacatggtggctcacatctgtaatcccagcacttggggcagctgagatgggagggtcacttgagcccaggaattcgagactgggcaacatagtgagactgtctatttttctttttttgagacggagtctcgccctatcacccaggctggagtgcagtggtacgatctcagctcactgcaagctccgcctcctgggttcacgccattctcctgcctcagcctcccgagtagctgggactacaggcgcccgccaccgcgcctggctaattttttgtatttttagtagagacggggtttcaccatggtctggatctcctgacctcgtgatccacccgcctcggcctcccaaagtgctgggattacaggcgtgagacaccgtgcccagcccaagactatttttaaaaaatacatttacaaaataagatacatttaaaagtaagttgtctcatctgacggcagccttgcctgggacactgctccaaaggcaatcttagcagggactcaaatctgattgttactgctgggtcttctccctgaccctgggaggtataactacagaatcattcatgcagcatttgcaacttaccaaagggtaactttccacagttcccagcgttagcttagcaaccagagctgcagaatatgccgtcctgggcagaaaagggaatggtgagtactgtcagttgagctttgcatcttctctaccttgttgaggacataacatctccatcagagattcttacaaacccaccaccccccgacacacccccaagaagaaaagcctgggaagttctttctacccacatgccatctttagaagttctccaactttatggtagaggtcatcccgtcctggaaatgtcagagaggaagattatagaagctggtcaggaacttaatgaacatttcctgcaatacactcattgtggctagtgtcaccaactttaacaagtgacattaacaagaggcttatctagctagcctgagtcagttttgtgcctcggtgtgaaagctatttctagtaccattttgcttatagccaggaatagttcatatcaaaactgtggaccagagttcatttttagaggacagagctgctaagcagaaagcgacagggggcccaacctcaccctcctagctccttccctgttgacttaaccttttgaaaacatagacatgggccaggcacggtggcaaacacctgtaatgccagcactttggcaggctgagataggcggattgcttcagcccaggcgtttgagaccagcctagccaacatggtgaaaccctgtctctactaaaaataaaaaattagcggccgggcacagtggcttacgcctgtaatcccagcactttgggaggctgaggcaggtggatcacgaggtcaggagattgagaccatcctggctaacacagtgaaaccctgtctctgctaaaaagacaaaacaattagccaggcgtggtggtgggcacctgtagtcccagctactagggaggctgaggcaggagaatggcacaaacccaggaggcagagcttgcagtgagctgagattgtgccactgcactccagcctgggtgacagagcgagactctgtctcaaaaaaaaaaaaagaaaaagaaaaaaattagctgggcatggtgacacacgcctgtaatcccagttactcaggaggcggaggctggagaattgcttgagcctgggaggcggaggttgcagtgggaggttgcagtgagccgagatcgcgccattgcactccagtctgggtggcagagtaagactctgtccccccacacacacaaaaaaaaaaggaaagaaaaaaagaaaagaaaacacagacaaattcaaagaggacatggaagcttaagctagaagacaaagaggaactagtgaggggtgtgtgacatcagccaaagctgttggcagggatgtgtcctagaaggcagaactttcagcttcctcaaggtcgttccttagtcgttgccactgaaaaatgggtctcgatgggactttgaaaaaaacagacccggcatctagtgagttgctgaaacttgccagctgtaagatctggagtgtttcttttaaactgtaggccggtttcctcatctgtaggattatgtcacactatctaccctgatttcataaggtaatgctatgtgagaatgctctcacttaacttggaagaaggtcaaagcaggatgatgttactttcctcaattctcttttaaagactttcttgagtgctggatgccatgagggaaagcgtatccgaaacactcatgtttctcatggcactgatctagggctcaggggactttgcacatcattgtgttttacctgatgtttaatcccaggcctgacagtggccctgcctcagatctcacgtcagatgggggcgggtggggaggacaaagccttccagcctctgtttctccagtgcagtcaacagaatgagctcctgtcccaagagcctgcaggatataccaacctgagagtcagacttcagcctgcagctccacaataaaaaaaaataaagcaagagtagcccctgcaagacgccaaaacaactacggagcagatcaccatggaaaatgcctcagccagacatgtccaggtccttcagaaacacattgctcatagagaaataagtttttgcaggtgtagtgagagtcaacatgaacataaaccaggcagttcgtcagtggccgattcagaagccggagccaagggtcctgactgagggaactgaggcacacacctttactctctgggtcttagctttaagttggggagagggtgggttagatctctgctttccacaagttctaaaaaatgttcaaaggcattaagtaggggaaagatgatctaataagtttggaaaattctggattcaatgcaatttgcttacttatcctaagatttagaagctattttaagctgaaattctccacggctcccagaaggggtgtgatatgcagttttagcccaaacttaccttgccatgatatcttctttccaggaacgtcagttgtgactgataacatgctggacccgtgttgggaaaactgaactggatgatctcaaaggccttttcccttcagatattctctgactgtgactgcttgaaggaggccaagaattagagtttcatgtcagaggccctcattgctaaagaagtagaggctcagtgtgattgggaaggcccacgtggaactaggtcatccccttcagctgcttcccaaccactgctctgtaattacaatgtgcatccaggaagttatcaaaatcctgtttggagaatattggattagcagaatgtttgattaaatcaataagtggaatactaaggggtttttctcttactaattacatctggaggaactaacctcgtctgtagggatagactaggaagctatgtttcttatgtaaatgaagatagcctaaggaaaaaatatctggaaaaggtaccctttcaactctgatttgtaaatgtcaaatagaggtgctcaaggagaaaagaataaacaatttcatgaaactcaacataaattctaattataataggaatagttgaattcataaattgtgtactctctgaaaagttaaatattagcctgaaaatacaaaaaggacttggatatttcatttttacactcttacatacacacaactttttcctcccaataaataaaacgatatttttgagggacaaatttggcaagttttgcagatgagggtgagaccttattcacttcctcctaaatttaacctaggttaagaatattttcagtcactatttgttgaattctaggtcttagtgttctacctggtcacaatttgtattgagacagaaaccagtgaactcaaatcttcatcagccctcattatcagaaaactttggctggacagctgattgatttgctggttttactgctggcttaatattgatctgactatgtatttcccttggctcgctaaatatatacaaatcaagagaggtttttgatgtcttaaaaggaaacgagtaactgactagagttattgcctaagacccaatatgcaattcagcttaacccacagggcacctgccatgggccacttaatgaggacaccatccaccactgctcatgctgcaagctgccaatgcccttcttaccccttcacctcatttaccccattatctgtaatctgaaattaccatcacctcccctcccactatattttttatccctctcttcttcctcctcacttcccatgacgacacctctgcttcaggtcctcatttcggttcagtagtctcgaaagatctctcttcccattctttcttcaaatgcatcgtgtcctcctcagataaaaagatctttcttgtcttcagtgggtttccactgcctaaaggataacatccctattccttattcatcaaaaaatcttccattgggtggccctgattatctggctttatccctcactgggccaccaggagatgccacacgtgaaaccacatggcacagctccccctcccggtatatacagcacgttgttgtgtctctgccctttggtcaatagtattctctttccaagaatgccttccccacacttttcttctagcaaaacattgctcattcattcaagcctggctcatgttgctcctctgtaatgctatcctactttgccttaaatgaccactccttcctttgtgttctgcactatattgtttatatcgttgtccgttggattcatgcatgtctcttttgtcactagcagtgatatacataaacatcccaaaaaaaaagtagctctgggacaggaatgtgtcagaggccttagaaatggtattttatttagtctttaaaaataagtcatgttattatatacctcatagaaacaggctcacagaggagaaattgaatgccccaggtcacatagctggtcagcagagctgggattcaacccagctgctccgtgtcaccctttgcattgcttcctgttacttctccactgttatcccacctgagcctgtgtgccttcctggggattagtcaatgtgagggtggctccaatactgtgtttctgttgttctgaagggctctgttctttgttcatcctttgttaggagatgtgaagacattctgagggagtggaagataggctgcccatcctcagggctcaagagctggagagaggggataaatgaggaagtgctttgaaagtggacacaggatgacattagttaggcatgaggcataatactgctgggagaatacaggaaagtcattctccttcgacttcctcacattatagtttttgtacaatttggagttaatcaaagagtagataaaccgagaaaaatgtgtgttcaacaggaaaaatggcagggtggggctgttctaaacctggggcagcagttccccactgtatctgggacagagtcatttaatttcagtagtggcttttgaatctgtgaggcccacttgatcttctactcctatcagctcagtgactcattctcccggcaaagacttggcgtcatcccagggaggcagagaggccaactcagtggtacccacaggaccgagtgagtctctcacaggctgcatccacgccccccatggcctctgctaatgaggtccacacctctgctcagcagcctgccaatgtgatgggacacaccccatgctggaagagctcccaaaccagactttgtggaaacttgtggctgcaggttcaaaaggctaatttggttttccactgtgcacagggctgccactcagtgcagtcttcagattgagaacacttcctcccactatgggcagtttggcgtgaatgagtgagatacgtagtttctggatagcacccaggggaatgccgaggatgtgcacacaaagcaaggctgactgttcctttgctgtttgtctactttttcccattttgtgctgagactcatctttccagcacaaacaccagggtgaggaattggaattttagtgctggaagtctccagaactatgatctagtgctcattccctctgatcccattgccctgacattatctgatgcttccacagctccttgtacagggaggtgtggagttgggagagcagcagcctgtggtacagggctgcccacagggaaggaagaagacatggcggggacatggcctgactcccgatgtgctccttcctgtagggtcttccacatggctgggctccctcccgtcccagcacacatcctgggtccatgtgaccttgagcttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagcccacacttcttgtgagtgtacacttcctataagtgtatacatcctgtgatcatatatttcctgtgagcatacacttcctgtgagcttacatgtcctgtgagtgtatacttcctgtgagtttacacttcctgtgagctctcacttcctgtgaacccacacttcctgtgagtgtacacttcctgtgagcacacccttcctgtgagcttacacttcctgtgagtgaacacttcctgtgagcccatacttcctctgtgtatacttccagtgagtgtatacttcctatgagcccatatttcctatgtgtttacctcctgtgagcccacacttcctatgtgtacacttcctttgagcccacattgtgggtgtacacttcctgtgagcacacacttcctatctgtgcacttcctgtaagcctacacttcttgtgaatttatacttctatgagcccatagatcctatgtgtatacttcctgtgagcccacatttcctccgatggtatacttcctgtgagcacacacttcttatctatgcacttcctataagcccacacttcctgtgagctcacacttcctatgaggccacacttcctatctgtgcacttcctttgagcatacacctcctatctatgcacttcctaagagagcatgcttcccgtgagcccacatttcctatctgtgtacttcctgtgagcatacacttcctatctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagccccccttcctctgtgcaattcctgtgagcacacagttcctctctgtgcacttcctgtagcaccactttctctctatgcacttattctgagcacacacttcctatctgtgcacttcctgtgactgtacacttcctgtgagtatacactttctgtgagcccatgcttcctctctgtgcacttcctgtgagtaccactttctctctgtgcacttcctgtgagcccacactttctgtgagtgtacacttcttatgagtatacacttcctgtgagcccacacttcctctatgcacttcctgtgagcacacacttcctctctgtgcactttctctaagtccacacttgctgtgtgcattctcacctgcacaatcactcttgctcttggggttcttgcacatgattctttaccaccccagaactctggaaggtgttgctttctgagacctacctctcttgtgtttctccaatgccagttcatccatagatttcttcctaaataccactggcctccctgtgcagtgctttcactgggacctgtgttttttcttggtggcacttacatagaaggattgttgtttaatgacagtcgactccaagactgtcattggtagatggtggcttccaaaatggcagaaccaagtcagccttgttctttgtggtatctccagggtcagccttccctggtgttcccaaatgttccctaactgaaaggatgtattacagttgggcttcctctccctaggagacataattaaatttaaaagtgggcttgggttgtttgtagtatgcagttttttacaggggaaccacagaatctttattccagatttttgaaaaggtgcgcggtgcatttcatttagtccggtaagccgtatttttgtgttctgttgtcaatacattttcagacacacatcacttgcgaaactcctaaaatcttttcaaaatgctctcacaagcacataaacacatatcttcttccttattactcaggcacttcagacccagagaattgcttttagagatcttgatcataatacctcaaagacagttttctttaggaagataaagaacactaaaatgttaataatagaaccttgagaccctctgaaaagaagacttatgtcagattgataatttaggtagagttctggaaaacattaatctacaaacatatgcctgatagaaggatatttgcagaaatggctgcaagtgcaatattgttccagctggtgagtgtggtccataaaaattcagtctttaaaaattatagtatagtctaattgtaggactgtgtgctcagtgaaaatgcactttacctatagatagggttgggagaaccaccctgtcttaccacagtgtatgtctgctcaacacactgccatgacctgggaagagaactttagggggacattcttatgaagcccttccctatacctttttgttagttccttataatcccagaaattttttattagggtagataaatgaccataaaacgtttccaccccgttgaggatgtttcttaggacttcttttatgacaaccatctaaactcagccacatctgcctctggcgtgtctagtttggggccacctctttgcatccccctgtgtaattattttatgagtgaagtccctgctggaaaccagccctcttcccagtcaaaatccatctgtttctccactgcctgtacatgcctttctctttacaatacagttagaccatttgagtcaccttctctagagagataacacaaaagcagaatcacagacatgtgcaatcttccagtaaatgtcttccccccatacaccatgtatggggttgaaaaatggtatttctataaaaaattggaatctgtgaagacagggttacagtgagaaatattaatacacacattgcagagcaggctggtgtcaggttctgtgccaagggtctgtggtgcctctgacaaaggagaacaatgctgaggggacgaagcagcaggaggagatggtggggggggtgggggggtggggggggtggggcgagctaattatccaaattggaaaaggcccaagccccttggattaacacacatcttccctgctgaagaaagtgctcagggaatgatcatgatcagctgccatgacctccacttctcctctcacagggcaccaaaccaacatgcatcaggtggatggctgttggtgatttacatgggaaatgactgtggtatgcagggatgcaaaatcagtgtggcttcttcctccagaagtatggggccacccttgcctcaactcataagaatacactgatgttctggtgttgcctcagaggccttagcttacacaattcctggggtcagggttgggtctatccaaccctagggtgtttctgcagaaaaacatagaccagtgttcctaagatgccagcctggcttctgctcccaatctgcttcctctgaatcatacctcttctttgcaaacgaggtgtttttgtgaacagaaaatatgtggacttgactgcttcatttactctctcagaagttcattaaaagcttacatacacaccaatcaaggctttttatgagacacagccaagatgttttatgtgtatggtgccaataaacacacttctccagaaggaactagtactatttatgtaaagtagacacttaattcaactgaatggaaatagcaaattagagaatgcttgattatggcattgaagatgctttctgggatgaagacattatttggaaaatctccagatgctcaaagcttgaggaatgctgggatcaggcaggtaactctgtaatagaattggacagagactaattctgctcaagaacagctcaaatggaaagctcagatccacagggaaggagccaacccagtccctttaacttggctatggtggatcaagatcgtcactggaactctttggttgtgagactcaatatttattctgtgtaggcaggagcatattggacccatcatgaaactggtactgtcataggctagacctgtgacctcctaggtgaaataacaaaggctggaaagaggtgtccccatgggctttggggaagacttctcttgcccaacagtgagcttgagcaattacttttctaaattgattggtttattaaagaaatattaattggacaagacaaccatcaatgtgaacctagttcaacacaaagaacattcaggccatcagatgaccaaagtgaagcttcctggtacttagcatctgccttatcaactcaggcctgacaaggaaacatgtcagttgctggagaaacacccataccctaaacacctcctgtcacacagtggcaacctgaattactgtgaatccatttatgcggctctcttctctaagagcagaggaagtaggtgtggccagactcagaggaggtcctcaagcaggaggtgtacaagtcagggttctccagaggaacagaaccaatagaaggtagatatagacagatacagatatataagaggggatttatcagaggagttgtctcatatgcttatggaggctgagtcgcatgcaggccatctgcaagctatagaatgggggaagctggcagtgtggctcagttcaactctggaagcctcagaaccagggaacctgaaggtgtaactttcagtccaaggccaaagtcctaagaacttggggtgccactggtgcaagtctcagagtccaaaagccagagagcctggagttctgatgtccaagagcaagagaagaagggtaccctagctccaggagaatgggaaggagagggcaaattcacctttcctctgcctttttattctatccaggaccttaaagtgattctaatgccagtctcttctggaaacatcctcatagacacacccaaaataatgctttaccagctatctgggaatcccttaatcctggcaagttgacattggttaataaaattagccatcgcagtgggtcagggagaaggtggccgagtgtctgcttcctgtgcggagggcaccacaccttctgaatgacttcttggtccctcatagcctaagaagtccggtgaaatgcatttgatctcttgactactttttaccccatcagttgtaccatccaccttccagctatcttcccacttcatgcccatgattccatgcactatttatgctggagcactacaactaagaagtctcttttgcatttctttcttccctccagcaacacatggccctttatgcagctctcacagccagtctgtatgagagacagaaataatggcattgcccttgggaaaggagaaacagataaagattccttctcttgacttctagcggcaagcagtgacaaagtgccccacaaaatttaaagcatcaaggagtagcccgtgggaagatatccatcagatcctccaatatgtgaattaggtctgatggggggtagctgctcactggtcatgatatcttgggactcctgcttctatccagcccctacatcgctctttcatgattttaaatgtgcactcaaggagctcactccaaatccaagcctacatgtatgcctaacctactccaaccagagagctccatatttatgtgaagaaaagggccatatctgattaaacaaccatgattctgtttgcaaacaccaatccacacattatgaaagacacagcaaatgtccccaaataattgattttattcacaccaagtttactctgacggattaccacaagtaaacatgtaaacatgggtaacacttcactatagtatagttcatgccacttgcctgatagaaaaccatggagcttctcttaggaatccattttggttttggggtttgtttgtttgtttatttactttttttatattaaaaagagagatgaggtctcactatgttgcccaggttggtctcggactcctggactcaagtgatcctcccacctcagcttcccaaactgctgggattacaggcgtgaaacactgcacccagccaggaatcctttaaagtacaaggaggattcagcttattatagagccagtctatacacaataacctgaattatatacctaacatgatctaaatccttagagttttagaaacactcaaaaatttttttaagcctcatttctaataataacacagtgattaaccacaatgcttggcgaattgcctcaaaacctttttggaagtagggaggatataaataaatcagttaatacataaataaaatgcttgcagctcagcgaccttctggttctcaggtttccatatatcaaattatggattgaccccgctaagtaatctccgaagtcttttctatgtagaagtctataaattttctgttaatcccagggtgagttggggaccattttgtcttttgtccttgtcgactgtctttgtgagaagctgagtctgcttacctgctgggttcagtgagcaggtatgaaggcatcatgtatggacattgaagagttgcccagagataagctctcacgtttggagaagcatgggtgtgtgggctactgttggcttcagcttgtgtacaaggatattcaattttagaaagccataattaatagtttctcttcttaccatattgaagaagtcagcttgttgccttctggcgaattaaaatttcattaaacttttcagttaagaaaatacagcttgttgcaaaaacaccatatgcaccttacgactcttttccccacccctcctcagtgcgactcccatcactgcacaggtggaggcagtgaaggggatgccttgctttctgagctgctgaaaacatcagggtttcagttctgtcttgtttactgctctatctgatcaccttgcattgtgcttggcatgtagtagctgctcagtacataccatttgaatgaacaaatcaatcaattaatcagttaatcagccagtcgatgcaggtgatgcctgttcctaaattcctttggtcccagtaggtactttgcaacatttccctttcttctgcttctgttagaagggacctttttaaacttgaagggcagaggcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggaaaagtacaaagaggaccacgagatacattgataatgaccttatccttaattcattccacacatactcagttaagtggcttaaataagtgatagagattttaatttaaatgcgagaatataaatgggcaaatatttgaatttaagtgaaattaacacaacgtgccaaatattgaataagaaactggaatttagttggcattggataatgtatttggtttgagatttgggtttccaaactgaatatataaatcaatgggcagatatacagtgaacacaaatataaataaacacagttccatgtttactgtttataatacgtccccccaaatatgtgcagaagtggaatgtgaagacaataaacaacttttttgttaggttgggggcaggggattctgaaagctacaaaatatcaaaccatttattcattgcatcccatctttaagatacagttttcatcaatatattttcaatgtttatacatgttacttagttctgttctttttctactcaaatgattgtacagttgattaatgtcacatggacttccattgtgattattcttttagctctgcctattcacattattaataaaaccatgaaaattaaattaatatgaccttatcattgtaatcactactttcatttttgcatttttctactcacttttaccaaaaaaaaggaacaagatgggaaaacaaaaattacataaaaacttcagcgtatggggaaaaacagagttgtctctaaaaaggatctgctctcggcatggtagcatcagagcatctactcaattgtcagccataaatgaagttcagaattggacacaccttcacagtcttccatatgccaaagcggattgttccaacatcagatgactccctgccatgtattccttgttagtttcctatgctaaatactagtaagataccaaaggatgttagaaatctgaggagaagttgcctaggatttagagatcactcctagtctaatatcagtaggtttttaggattacaggttattcaagggctgcttcctgtgtgtagaggttgtattatgagtcctgaaaggagagagaggaaaagagtctgccgtattcagaataaaaaggcaacaaagacagagtgttttgcggattgccagataagtcttttctgaccgttcccaatcctgaaagttctaacatggagactgcttggtctttgaaggaggtgaattgcagtaaacaaatcatgaattatcatctgcagtagatttgaaagtctttgagtgaatataactgggggatgtaaccttaactttcagataagtttctaaacagttcagcatatcattttaaaatgagcaatggatgtttaatgaagaaaatatgaaattcaggttatcatgtaaattacaggtaaacaaacaaaagggaaatacaaaagtgacctatactctaatcacccaaacagaatcactgttaacaagttggcaaaattctttctgggatttcctaggcatctatagtccaacttagctctatgtttatttaactacatttatgcatacaaatacttttctttacaaaatggtgtgactttattctgtaacctgctgctttgcatagaaataaatgatgagcatgttttatgtctctaactacacatttatcttgtcttaatggctgcttggcattcatttcttgggctatagcttcacagatttagctactagatagtctccaattatacgcaatagcacatatacctttgtgccgttttttgtacatatatctttgtacattcattaaataatttccttaggataagatttttcacaaattaataggtcagaagtatatatttttaatacatatgaggtgtgttggagaattatcttttagaaaatttatatcagtttatattctcaccagcagtatatgagggaatctgttctaatcagacattctcaacacaaggctttatcattctttttaattgttgccaacctaatagatggtagactctactaatttgcattttttgattacttactaaggttgaatttttttcatgtttattgacctttttctcttgcctctttgtgttcatttagccctggtatttggtatgatttctcctaatgctttgcaagttaataacttattcattaattcactcatttattcatttattcatttacttatctacatctctttcttttctgtgtgttgtaatctcatcccccccatactctgagctttaatttgatttatggtattttgtggcatataaaaatctttccgttttatttagccaaatttaccaatcttttcaattataattttagacctgaacaatttgggatctctgtgaattcagttattcatctgcatattcaagctaaaatagagcagtggcttagaaaccatctttcctaaaactatgacaatgccatttacagtaagagtcaatgaaatggggggagagtcattcaatgttcagaatagaaagatttagaagaatggcaaagttgagcatcatacctttatgaagtgaattgtgtccttctcaaaatccttgttttagccctcacctccagtctgactgtatttgaagataaggcgtttttttagggttacatgatgtcataaggatggggccctaatccaacaaaactgacatccttataagaagaggaagagacagcggagcttgctctctctgccctgtgaagacatggtgaggagaaggctgtctgcaaaccgggaagagagccctcaccagaaaacaacccctccagcaccttgaccttggatttccaggccccagaactgtgagaagttaaatttctgttaagactcccagttatggcagccaagcagactaatccacttaggctgatgcagtcaccagttctgctgggcacaattctaagatgcctcccaaaatgctcacttggccctggcgcctacacaccatctcccagttgtttactcaagcactgatttcagtgctgctgcaatgggatttggttataattaaggtcctggatcagttgccatccaaatggggagataatctgggtgggcctatttaaacacatgagccttgcttttagaaagacccctacagctagtcacagaggaggcgactagagagactttggatggcctctaggaaagcagacctccttgtcatgaactgcctgggggccacatgtaaagagctgcaggtgcctctagctgagagctaaaaggaaagaaagacccgagtcctaccaccacagggccctgagttctaacagccactgagcttggaagaggactctaagcccaagaaagaaatatagcccagccaaactcatgggaccctgagctgtgagtccgtttaagctgagcctggacttctgacccactggaactggaagataatgcatttgcattgtcttacactggtaggtttataggattttgtcacattgaaatggagagtgaatgtgtcagtgtttacatccctgcggagcaaggagggtgccagctacggaggtggagtagggggcctggctctgcagctggggcatcgcagacagcggtttggctaacggtgcagctgatcttcgcaagttcccaccctgctcctcatgaaacacagttgcgcctcgaacaatatgggcctgaactgcaagggtccacccaatgcatattgaaaatacagaattgaaggaagaggaaggggagtcccgcatatacagagggctctcccatacagatgagtggaaatgccaccgggtgaaatctgttggaacatccatacagaagcaaaatattagggaaacaacaggttacagaatcctccttgaacattttttctttcagagaagtcaagtgtgtaggtatttggagctaggctaggtgataagagggacgtaaggaatgtggtgtctgtcttacatgtgaatattgaggacccagtatctacagccacaaagtgacgaccaggtatcacccagcagcaaacttctgaaagtcacgctctgagaagcctctgcctccgatctggggccttcacctttccaggggcccaccccatccctcctcccagccttctgctacctgtctctccacttcttctacaagcaccctctccaaaactgccacatgttctcctgactttgtgtctctgtgggattgcctctatgatgtatcaggaggacgtgtggttcaggggccaactgaaacaccatgtcctttggttttttgtgaagccatcccccatttcctggaaccaaaatagatcccacagcacttcctgtgtaccctgatacctaacaaaatgttttaaagattgctttagctggagattcttacatatgtgtgtcctcctgggacagtgagtccggcaaccaaccctcgctgattctttccctccctccctgcctctcgcagcagctggccaactgccccttctccagcaggtgctccctgcaggcttgtgaaatacactggagggcaattgtctggctcagactcatgttgccatcagcaaatgaccacgtttaagaatgttatgccacctctatatttggcctgcattattcatataaatatgcttggtagacaagggacagaaggcacttgtgtcggagaaagacagtttaaagggcaacgacctaacacactataaaatacagggagtggggagtggggtggagggagcaagccgcgcggctgccaggcagggccctgctcccctgggtgcacttcctccctgctcccgtgggtgcacttcctccctgtccagggagtgcactcgcttcattgcccagtgcgactgggtctgctttgcaggggccatatctgtctgattgtgcttgggcagatttctcttgtctccacctagctggggtgattcaagtaggaaaaaagaaaaccctcctgcacagattgtgcgatcatttcatttccttgcctttgtttgtcatttctcctgtctgaaaaaacagggaatccactaaaggccagaacattgtactctgcttccatcctcatgaaatcttggcttttctttgcaggaagcgtccaaaataacacaggattggtcctggggtcccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttcctttctttttctgtcggagtcttactctcgctcagactggagtgcaatggtgcaatctcagctcactgcaacctccgtctcccaggtacaagtgattctcctgcctcagcctcctgagtagctgggattacaggcacccaccactatacccagctaatttgtgtgtgtgtgtgtgtgtgtgtgtgtgtatatatgtatatacacacacaaacacatacctatatatatatatttaatagagaaagggtttcaccatgttggccaggctggtcttgaactcctgatctcaggtgatccgcctgcctcagcctcccaaagtgctgggattacaagtgtgagccgcagcacctggcctattaatttctgtatttgattttttttacagcacatgaaatagttttgatgtttaaatgaaggaaacaaaagcagtgctttcgatagcccaagcttatctttcctaaatgaacccaaacctcacagttattccctttacttcccactcccgatcacacttgtcccaggtggatcacgtccgagaccagcactccatgaattttaggagccagagcggaccgtgaaggtgtcctggtagctgaggtcctatggccgctcatgaaattttagtgagccatggcttccctgaggctgtggcccgcaaagtctgaagggagtcacctccttcaaatccactgagcaaggcctggggagtaatgggaggtcccccgtctgactcacacctgacagtcgggcctgtcccatctctggcaccagcaaccgcccggggacggtgagggaccatggggtcagcctcagactctctgcacatgtttgctggccaacgttccagccagcgggcctggactggagggctgggatggagagggtggggcaggaaggcagagcctgccctgagggaaccgggaggtgttccgcgcaggctctgctgctttctgacgtgtgaccgtgtgcacaggatttgtcccaagtcccacctgcctcttctggaaagtggagcgatgatgtgagcaggcacagaggtcacaaggagaattcagggatctagagacccccagagcttgccctgtgcccatgctgcagtgggcactctcctggcatggccacgtctgtcacgcgtgatgctcacagcctgctcactactagaaggctttaattttctgaagcagtgatatttaatttatttgaaatttcaaatgtcattaaaggagacgtgctatttttaggctaggaatttaaaatgcttccaaaatgcctcatccccatcgctcttattgcaagcatgtattagctgttctcacgcctgctgagaatgccctgtgactgaagcaggggctgcttctgggggacagtgcagccaccatgtgggtcaatataaggaaatcaggatgatacaagtgatgtgggtttgcaccatcatcctggctgctctgtgtgctgacgtgtgtataacattgacacgaggatgcctgtagcagatgggggtttagctagaaagcaggaggcagtgcacgatgagtatggtgcagtatctccagcagacctatgctgggcagaaacctcacagttctgtccaaagggagcttcatccctccgatggccattcccctgcagtccgtgaacccccaggatagctgcaccgcatcagcagaacaattgcagtgcctttacagtgaaggaacacaggctccagctgtcagctccatctcaaaacctacccaccccactcatcctgcacacgctgccccagccccatgccccagaggctgcccaagcacctagcgaagccctccaggatgcttggctctgggcctgttgtttcaagccctgccctgccttctggctgctggatggggaattgcagtgagattccttccctccgaagctccatctggtgcaacatctggagctggtcccccagcataggaggatgtgagtgggatgatgaatggcacctcagaagtgtgctgttggggagggcccacctgtttaccaacatgattgcaaaacttaaatagctctggggattctgaactgctcttcttggggggctccccaccgagagcattttaggccctgtgcatagcaggattataaaaaagtcatatttaagacttgatcatgcttctggcatttggaaggaaatggatggatgaagaagaaacagaaaagattatagagaactggaaaacaacaatttaactgctaggatatgaatcccaaatgttataggggaagttctgggatgaagagaagacggagcaatggctgccactgactcagtgatgtgtaggacatggggaagccgggattgtggacactccccaccgtggtaccccccgctccagtggtaccctcccccgcccccggcatgggcagctcagaccaccgggaaagttccagcaggcagatacattgcttcccacacaagctcattgggagaaggcggctctttttttctcattgttacaatatgatttgattcgtggtgttgtaatgattagcaagcagaaccaatgtggtttctttccccagcatcgcttgaatctacagcaaactgtccagagaagggatcacagtgggattctgatgccttattatgatgtcaccttcacgaggaggtttagaggtttgcttttgttttgctgttctaagaaaaaagaatgtgccatttggacatttcaccttcaatttggaacttaaaaatttagtccataaacaggaaataaacagaacttttgagagctccctctctcatttggcaaggccccccacttgccctcagcacttgggcacccaccttgacttacagaggaagccctggaaacagccaaggatgggggaaaccaatcctgggagcacaggggtactcgcctgccaacctgctgacctctgggaccaaataccagggctccgtggagacatggctttttctgggaggatatactgaaaaacagagcaaaaggggaattgtttgctgtgtgagattgccaagtcagccctaggaaagaaaggcccaagggcacatctgcagaaggactggagggtcagtctgagctcatatttgccaagtctccaaagaataggcatcttatggtctcagcacgagggagaagagagaatttcacctaggatggcttccagtaagcacctgtgatgtctgggttctctccattcccaggcctgagagcggctgcacagtcctgattcctggagcgctggcccaggccgggtcctccatgtcaccccctttaatatctacatttattcatgcagacgcggactctgagcaaagtatcaggagcctggtgattcaagttgggagaatccaccaaagtgctttccccaccaggattcactcacttgggcctctttggaggctcttcctccccactctcctcttaaaggccaggagagaggctggcaaggtcgcctgtctccctcctccacacctgttcctagatagctgcttcctgccgggactccgtgatcttgtctgcaatgggtccagatctgtagactgtcatctaacccctagattcctacagcggactgactaccattgtccgtgcatagcaagcttgtccctaaagctcagacgatggcctccccagtgcttccccagaacccgatgtggttttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggtctcgacacggttcacacaggcaatgccccgccatcattgcttccaattgtgttcgacgggaagcagacagtagcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctccagttgggaccacatcagtgcctcccgtctcccctaccccaggccacttccctccctcctcctattaacatcatgctccccaataatccccacagccccgcctcagcctctgcttctggggaacctgacctaaggcaacagcaacatttccctggggctgaggaggcaggcatgcttttaaagaggcttttccatcacctttgagcatcacctgcctacgagatcaaccccacacatttgagtttggcacatgacacattgcacggcctggcacggcctttctttcctgccttcatctttcgcctctctatgccctgttctttgagcttagcctggggttctccacagaaaccacactgttggactcttttatgccttggtgcatcctagatgtcacattacagtagtttggagagacttttcttaggtgtaagtgagataaaggggttgctggaggtgctggctacagggcagtgacagagaaagcagtggggtaggcttgccacatggaagagagcaggtgaaggaggagacataattttttcacaggaggcagctgctgcctgtccagcacatgaaccaggggtacagggatggggtgcgaccagcagctaatctaactggtgtatcttcacattgcatgttaccatcaggatggagagagcaggtgctctctggaccctctgtctcccagcctgactcttcccaagactgtgagcacctacagagcaggcctcaatccataaccttggtattcttgtgttgagttttatgcccgctgcaatgctagactgagatgcctcttgtatggaaaatatttcttaggagtttagcaaatttatgtcattggctgatatttcaggccaatccattttgggattagaacattatcaggatgtaaccttagagttcacttagttccggcaaaacctcttaacttcagttccctcatctataagaataagggattcatttgtgatcatatagctcaggtaatccaggaccagaaacccaggagcgtgggacctgatccacagctagaggatgggggactctgtagctacagcattttcctgaacacacaagaaatccagtaagcagcacacactggctgagtcggctttccaatcagaaacaagcccttgacttgccggagttggaagactgcaagtacctgcccaaatgtccacccaacagataaactccctgttacgtacataattacaagcattctttacctgacagtcccatggctggacaagccaagctaagttttcagtgtacataaaaagcataaaacccgatgaagtggcctgcctaaaaattaatgtgatggccgcaattgcagcttttgtggccctgacgttagtctttgaacgagtctgccttctgggtcaagtgaacttttactctgggattatagaaagcaaagtaagtgatctcaactccctgccgcttatacaagaggggagttgttacttttactttattttattttaagatggagttttgcttgcccaggctggagtgcaatggcgggatctcggctcactgcaacctctgcttcctaggttcaagagattgtcctgcctcagcctcctaagtagcagggattacaggcatgcaccaccatgcccagctaattttttgtatttttagtagagaccgggtttcaccatgttggtcaggctggtctcaaactcctgatctcaggcgatctgcccacctcggcctcccaatatgctgggattacagtagtgagtcactgagcctggccttattacttttagataaaaggcacttgttacatcagccatttcacatccattgataaagatgggtgcttctgaaatggccacagctgacagccaatacacctgcaggtccaccctctgctggtcattttctgaccacagtaagtgctcagcagccatccccagagcaggggtcagcaaaattctacatcaagggtcaaatagtaaatattttaggctttccaggacctacagttttcctatcaactactcaactctccttttacttgaagcaatagtcaacacatagatgaacgggtgtgactgtgtaccaataaaactttatttacaaaacaacagcaggccccggggccatagtttgctgactgccgccattgtgtagcctgaagtggagctcagaagcaggggctccagccgtgggtggcaaactctcaaacccaatgacaccaacagtatctttggttagagcatttagagttttagccatagttcaattagcagctgatgatttgttcctcgatcagcccaagcatgtgaaacataattgttccttcaattcccatcagccaggaggtgacagggaaatgacctattagctgacttcaggcagcaggaaaagtccaaagttggctgctgccattgccatattgattggtgatccaagagaagtgtggtaactatgaccaagaagaaaaggtctaggggaactattccttatattgtggaaatattccatacttcgctgggatattttcactgaaatcgttttgaactgagaaccagggccattcctctgactgtaaagctttgtagaatatattcaattctgcatgttactgatgggtgctaaccttttgtgtgtgtttgtgtgatgttcgggcttaagggatctctggacaataataatgataattcagctgcctgggatcttgatgaaacccatccactccttcccacctttcccatgtcagatcttctacaaagcaaactgatgctttcagtaaaatattactgatgcaatccaagaaacagaaaaaacagcccaccaatttactcccatttgaacccctgaagcctgttcacagtattaccacattgttattgaagtttacagaacaaaaccatagatggaacccaagaattcttctagttcaagcccattttagagctagattgactgaagtctaaggtgatgtgatctatgtgatttccccactttcaaatatctcctaagaaatggccatagaatgtatgagatttctttttaaaagaactttactcatactgcatacatgcatgtacacacacacatgcatgcacacacaccaaagctcaggatctcctttgaaggagtgtcgagctcacgaatggtaagagcccgtgtggctcaggccctctgcagagccagggcagagagacagatgccattttggggacaatttaggctgcacagctgctctctctgaactgccaacagctgaaccaaaatgctcaggaggtgggctgggcagccctgggctgtgggcacagtgtccttgggtatttacaatccctcgatccttgcctgattggttttccataggcagggcttcgtccaagttcctagggtcgcaataccattctcattagaaggttcctcttgagagacaccatggagcagggaaggtcttgggtgtcctcccatctcatttgcccttcccctaggtgcctgtgtttcccatcccagtggggatccaaagcatgtcctgggcattgggtaagggtttagaaccttgtccccgcctgcatatgatagacatggggagggacaggatcaggaggttgctaggtagagcctgcaggtgcctttccctgaactctgttatgtggctgagttcttcagagaaatagtcaggagctaaggggttaaacaagcatccctccctgcagagacaggcaggtcagaggctgcatctgttaaattagggtccaggccacagaggtaatacctaccactctaaactgttagccttccaatactacactccagttctgggagtgagtaactgtgtgtccagagatagaagccataagcacttgagttacagaactgctgagaaattggtctgatggtctagtagccttgtgccaggagaacagttcctatgtagaaactggtcagcattttcttctgaaaacgtaatcatcattgcagtgagtataaacttccatttatatgccaggaacctataagtttcagaatgtgtctgatccctgaagatgtcccttctctcagacggctggcccttgccccactgttgctgggttgtgtataatctgtatgtccagtcaacctcagctctcagcctctgagcccaggggacagaaggccgtggctttaaatgttcacttaaatattgtcaaggtagtatgtttattgtgtactcccaatggttgtcttagaaaaccaaggatggtgtcatccttagacctaaggggccccaggcctggcagtgccttccttcagagttctaagctccaatgcctgtgtgtggcctggctcacagagccatctgagcaggacccctgagcccagcctgtcttcccctcttggatgttctccaaccctccacccacccgccccatgcatgagtcaaccagatgccctgaggagctctgggacttgcacctacagggtcatcccgaggccctgtggccagataggcaccaatcccaggagagtggggaggtgagctcatctcttttgcaggccggcatggtatttctttggcaggatgctgtgagactgggtcccagaacagtgctggcctgttcattttggatgactcaaattgctttttaaacaggagtcctgaaaaaagtatttggccaggcccagagtactataggggcagccctgaccagggaaacattaatataccctctcccaaaatacaaatctcttttagactgttgccagcagtctcaggaatgatcaatactagtggttgagactagagggaccattaagtaagtggagttgatctttattggatatagctggccctctttggtaagatgtgatcagaagagaaattcaggcagcaggctacataatcttcatagaaagtaaatttcaaatgcatcatacaaaattcacagacaaacacatataattgcttaattgcttccttgtttaataaaatgtctttcctgatcaatacctcttaacaagttgaccaaaccaggtatagtttagcctcctgatcagatttagaccttgaatttaatggaggtatagataggtaggtaggtaggtaggtaggtagatagatagataacccatgaatgttgaagaattgtgtctatattaaaatttagccaaaggagaccagagtaatataataaatttgttcctatgggaaaagcactttaagcaaacatgtgccccattggtgggtggggaggtatatattggtgctattttttgtacagcattacattgtttccctggtggggaagaacaggttagctttataattttgggagagcaatttaatttaaaagatataccctcactgggataattaaatcctgatgtgtgaggttctttcaaatggaagatttgcttaaggtgttcacattttggttattctgaacatttctacttgctgtgttgcggagtcacgatactgaagggcacacatgtttttgtatctcacatatgtgacacatccttatctaaaatttcagagccaagagaaaagaaggaatcagatagtgataacccagtgaggtatctgctgcacagtctgcctctccaactttgctgaggaaactcgaaagtatggaaagccaggagcccggcacaggtcccttcccagcttctgtctcttagcctggcagagacttcagaggaggaactccctgagaatgggaagtcattctctagttgtcttgtgcttcgtgtttgtttttcattgtctttttcaaagtaatgtatgcacaacgtgggtaacactgacttttattggctcatagtgacaaaaacaatagtcccctgcctctctcctcctgaactctggccttgctccccagttgctaatatgttcaatgatttttgctatttcttaccaacaactactttaatatttctccataacatgcttaaatatttgtacttatttgggctgggtacggtggctcatgcctgtaatcccagcactttgggaggccgaggcaggcgaatcacctgaggtcgggagttcgagaccagcctgaccaacatggagaaactccgtctctactaaaaatgcaaaattagctgggcgtggtggcacatgcctgtaatcccaactactcaggagtctgaggcaggagaatggcttgaacccgggaggcagaggttgcggtgagctgagattgcgccattgcactccagcctgggcaacaagagcacaactccatctcaaaaaaaatatatacatatatatgtacatatatatatgtatataaatatatatacatatatatttatactaatttatttagatattatgcattgctttcctactgtaatagatgaagattaactcttccgtattacttttcacccaatttcaccttcccccatactcccatataattatgtttcaattttggttaaaccaatatgagatgattgcattgttgctgaacaagaggtacaatattacgttctctttttgtatacaaagactgttaatttagagacctagagctttcagatcttggaggggttcttctatctcaataactacccaacccccatgttcttttctcagagttcatggaattgaataatttggatggatattctaatttttaaaatttcttttttccatttattttaattctgcattctggggggtttcctaacctttatttttcagcctgtctattggctctaaatttggctaccattcatttaattgctaaggtctcttgtcctgtttcttcctttttttaaaaaaaaaatctcctaaatttctgaatgcaaaacattactatattttgaggctattccgaagaaacagattttgttctttttgaattctttttctctctgcattgtctctattttgtaattttaaatgtttattcatttagtctctgtctttatgaaacaacattcctcaaaggtctggtggtatctgtctgcctcagtagaataataaaagctgaatagaattttgggggctgagagtagagcttgtccactagcaggtgttactgtgattaagcagcgagtcagcttttaaactgaggactctcctatttgatggacttttctctggagccccctcattttcccagggcggaatccctccacctcttgcccagggaacatagctgggctgctgctgctctaggacacgggtcgggaggaggaggctgggaagggtgtctcgctcttccatgcaagcacttgcacactgtcccatcttcaactcagagcctcctcccattccccgctgggactggagtctctgagacctgaataccttaggttcagttcctccagagaatcaacctcccatctcgtgtgttactggaggagggtttttgcccaggtgcctgggctgagggaagggatcagaatacgccttattcagactttcaaccttcctgcatattcacttgctcacctggtttctgcccttccccgcacccgggccctcccatccccgagcccctgctccgtggttcctggcacctctcttggcctcttcttggcgttcatcctcgccaggtacttcggttcctgtttcttcagttccaccaaaccagccagtgttctcccacccatggtctgtctttgattacaggtgttgaaatgttaggtctgatctgctgttctctcttctcactcctcttcctgtggatttttaccttttttttcatttagtgttattttggtggattttcagcagtaaagaggaaataaatacatattaaatccagaagaatccagaatgtttaaatggaagtctttgatcctgtctgcttttattcagatcaaatggatcagatgacttaaatcaaaaggtaatatttatgagacacaaagaattactctctcctctcaacaaaaataaagcctccgcctctaacatcatccagtctgcctcccagacatgaacttgcgcacaaagatgtcagggagccatcaggcacggcactgcctaaaaagcccatgtggcataaagaatgagcaaagcgctacaaatacagggtccttctatacaggttattcacactgatcttcccaacagcactattagttggtaatatgtctatattgcagattaaaaaacatcagatggccagtcgcagtgtctcacacctgtaatcccagcactttggaaggccaaggcaggaagatttcttcagcccaggagttccagcccagcctgggcaacatagggagatctcgtctctaccaaaaatcagaaagttagctgggtatggtggcacatgcctttagtacccccctacttgggaggctgaggtggaggatcccttgatcccagcagggtcaaggcggcagtgagccctgatcataccactgcactccagcctggccaacagagcaagatcctgtctcaaaaataaaaataaaaataaaataaaatacatcagacatagagcggttaattggctacccaatccagaacaccaagtagcaaagacaggacttgaacccgggacctccaggtgtttctgggtgttctttgagttcctccatcctgaatcaatagtcaagcatcatgtataaatggagccacagtcctcaaggataaacactaactgcttgtaggccactgcaggccattcagtacagtgttttattgtgctgcaaagtcacctgtttccacaagtgcttccccaatgcaggctttctaaagtcatcatggaaagtaaattattttcccctaacaaactatgctaaaatgggcaggatgagcaggaagtgcttgtgtggtctacattgtatacaactatcacggaaagttcaactcatgggacacttgggttatctggaggacacatggccgtgagaggatgtggcgcttagaagctcccttcatcacttggttggccctcattcatgcatgctgaggagggggtgggaaaagttatagaagccagtagccaaacccggtatacccaaatgtttagcttagattgaagctttggtgtttctaatatgtacattcggctcacttccagaagacagagatgggggacttgaaaactagcttagcagagagttagttaatcctaaacctacctcgttctgtcaccttggcgatgaaatgactatcctaatacagtcagaagaggacttaataatcagccaggcaggtgcggggagggaatgccagaaacatgcaaaaccgccgacagcaagaagtttccattcttttgggggtgactgtgcataattaagtgcctacaattcccaaattaaaaataccagttcctttacaaccagcagtggcaggtctactcaggggcagtcaggaggctcccacaagtgcagctgtccagcactgcaccacacctttctcttttctccaaaagaaatagttttatataatagatatatccaaaaatgtagaggtcataaaaacaacagcagataaagctgtatccttgttggttttatttgtttgcttttggtgttatgtttagggtaacatgattgctgctgataagaacacattacctttgtaaacccagcactttgggaggctgaggcaggtggatcacgtgaggtcaggagtttgagaccagcctggccaacatggtgaaaccctgtctctactaaaaatacaaaaattagctgggcatggtggctcatgcctgtaatcccagctacttgggaggctgaggtgggagaatcgcttgaacccaggaggcagaggttgcagtgagccgagatcataccatcgcaccccagcctgggtgacaagagtgaaactccatctcaaaaacaaaacaaaacaaaaaaacacctgtgtagagcaagttcaccttttcatagcacatgcagaaagcacacctctgtgagtttgcaaagagaacagccctcttctgctgtgtgacatttcagaagatggaggctcagaagcttcaagtcttattttgctaccaggacagaaacagaagccaaatctttaggcttcagatttacctttttttcctaagagtgggacatcatatttaattttccaggtcaaagaccagcgcttgagttgatcatagatcttctcagagaagtcatctgaaagggaagtagtctgttttcttagtcacctgaaaagccatagaataagataaggcttagaataagaaaatattggtttctccatgagaagaaggaagagaaaaccaagttgaaccatttaagtctcagttgagttgaaatactcaagtgacaaaataatctgaaaattaaaagtatggtgtatctctaaacaattattttagcaaacatactctggttaaaaatgtattctaaagaaggttttatttaattataaatatctatattttgtttttcacctcttccaaaagggtagaataaagtaggaaaatgcacttgggttcatctcgaaactcagaggcagcgtggtgtggggcagagggctagcatgggaggtgggaggcctggtgttggcccgggaacccgcactgaccagcctgtggccagggcctcatctgagtggagggaggccttggtctagaactgagattcaccatacaagctccccagtctgcttgtggaccaggagtgtcttgggaatgggaaccaaactaatccaaagatgaagttcaactctttggttcttatgaagtgaataacccacaatgccatagacattcatttttctatacacttaagggttacaaaaggagttattaaatgtgaataacgtcttgaatatataaaattagactgcagctacagatttcccaggatccattccatattccctggaatccagcttgctccaagagcctggcacactctggagcttttgcttcacccagcaggtacggagtcaaactcgacacctggaatctgtatgttgctagtgttgagtggaactcaacacctggaatctgcattgctaacattgagtggaatttaacacctggaatctgtgtgttgctagtgttgagtggaactcaacacctgggatctgcattgctaacactgagtggaatttaacacctggaatctgtgcattgctagcattgagtcaaacttgacacctggaatctgatcattgctggtgttgagtggaactctgcacctggagtctgactagcattgagtggaacttgctagtgttgtgtggaacttgacacccagaatgcatgcattgctagtgctgtaaggaacttgacacccagaatgtatgccttgctagcattgagtggaacttaacaccagaatctgtgcatcgctagggtcgagtggaagtctacacttggaatctgcattgctagcattgagtcaaacttgacacctggaatctgatcattgctagtgttgagtggaactctatacctggagtctgactagtgttgaatggaacttgctagtgttgtatggaacttgacacccagaatttatgcgttgctagtgttgagtggaactctacacctggagtctgactagcgttgagtggaacttgctagtgttgaatggaacttgacatccagaatttatgcgttgctagtgttgagtagaactcaacacccagactctgtgtgttgctagtgttgagtcgagctggacacctggaatctgtgcgttgctcatgtttggggtttgtacttcagttattttacttgctcatggctttttgttgtaattgttttttgtttcttttttatttaaaaatcatcctttaattatctttagtatcttcagtttcattcactggcttaaccagatagtcgacaattatgtgttagacatatctgttctgaaaaatatttttagccctcaaattttttcaaaactaatttgcaagatgtatacgcactgtagttcaaatgtaaatcatcagtgtcctgattactgaggcagatgtatcaataagatcgccagatttgctagtgcaatgatgcttccttatacagcaaattatttttcctatggggatggtggggagatggatttggaggtgatttatcctgtaagagcaggtttggaaagttaattagcctctggagaaggttccaggatctctggggctgggtggagctataggggtgggaagcacctgggccactactgtgcaggtgtgtgcagtgaggatggctccctgtgcttggcccctctcactacagggcacgccttcttcctgccagctgtcctcagagacaagagtctcactcagcttcagctcaggcccgctctctactgagccttccacctggacttccaagtggaaacaccccaaagatcctcatccctttcctccactcgatgcctggtttggctaccacccataagtgtggtgttctgcctggccccgccaaacctcttccaggcacccaaggtctggcctctgctcaggttcaggtcttgggccatcgtgtattttccttctcagaataggtgcctgggttgttctgactatggtctaagagtcttccctgccctgccctgccctgccctgacctgctgtcccctccccttccctcccctcccctcccctcgcctccttctctttccctctctcccccgctccttccctccttcctccaggaattaagacattgaacattctgtctcatttccatgatttttcaaacagtgccaaaagagccagcaaatgactgtgcgattatctccaccaacctatttaaaacattgtcgttgtgtttgacttgatgtggtccttcatcttgaccatgatgtttgttttactgcttccttgatgtataatttacataccataaaatctacccttttaaagggtatgattagatggtttttagtattttcagagaattgtggaaccatcacccccagtctaattttagaatattttcatcatccaaaatagaaatccaatatccattagcagtcacttcccattcatccttcccctagccttcagcagcctctactctgctttctgtctctgtggatttgcctactctggccgtgtcatataaatggagtcatttggacttttgtgaatggcttctttcatggaggatactgttttcaagattcatctgtgttacagaatgtatctaaactccattcctttttatggccaataatattccactgtatgcacctgtcacactgttcatccatccatcagttgctggacacttcctggctggttttcactattcagctggtatgaatgaggctgctatgaactgttatgctcaagtttttatgtggatataactgttagatttataatcattctaattagccattttgtacttttttttaaagttttttttcttttattatactttaagttttagggtacatgtgcacattgtgcaggttagttacatatgtatacatgtgccatgctggtgcgctgcacccactaactcgtcatctagcattaggtatatctcccaatactatccctcccccctccccccaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatgaccgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccatcacctgttgtttcctgactttttaatgactgccattctaactgatgtgagatggtatctcattgtggttttgatttgcatttctctgatggccagtgatgatgagcattttttcatgtgatttttggctgcataaatgtcttcttttgagaagtatctgttcatgtcctttgcctgaaactgggtattttattcctcagaaagaaagaggagactcgaacttctaaacataaattgtgtttgaaaatattggagcttacttatcctaccataaaacactcagtttaaaatgagcagttttaagatacttggttttgttccaactaatacctctcctgcctttttttggtcaatttatttttgttattaaaatttcttctgccgttggcacccccagaacaatatattcttcaatagtttaaaggagctgcttcctcactgggatgtggacccttcttccttcttttaattacagcgttattaaactcctccaggttgacactttctttcattctctattttagatttgtcaatcagaggtgctccatgaagcagctccttagtgctgggggaaatgcaaagccatggcgtgtcactgtgggtgcaaacctgcttctggagctgtgacgttcttggggagggagggctgtgaagggtcatcttggaggggccacccctgcatctcacccgtgagccatccttctcagaggatgagagagtggataagagctcaggagctgcaagggagcattgcgggagcactgtgcatcataagaggggaggatgaaaccgacaaagacgggcacctggcagggagtgctagtaaactgaggcgtggactacagaaacaatcctcccccgaagaacttttgaaaatattgtacagacccagggcaccctccctgacctacagaagccaaaaccccagtgtgggagcacagtatgtacgtttagaaaagttttcatatggccgggctcagtggctcatgctgtaatcccggcaatttgggaggctgaggcaggtggatcacctgaggtcaggagttcaagaccagcctggccaacatggcgaaaccctgtctctactaaaaatacaaaaattagccaggcatggtggctggtgcctgtaatcccagctacttgggaggctgaggcagaagaattgtttgaacccaggaggcggaggttgcagtgagctgagattgcatcactacactctagcctgagcgacagagtgagattccatcttaaaaaaataaaaaggcagaggttgcagtgaaccgagatcacaccactgcactccagcctgggtgactgtctcaaaaaacaaaacaaaacaatacaaaaattgtaagtatgtgtggggctcatgtgctgagtttggtgggggaaatctttccatgcacccccacaactgtctacaatatgaaaacaatcttcaagaaaacaccagcgaacagaccattcgtctttccctgttgccacattttatcttggtctcaggctgctgacctgtcagatgattgacaaatggaaaccgtatggtggctcagagggaccaggcgtggtgtgtgctgcattgaggagagggtgggtaggcaaatagaagttaagcaccctaacagaaatcattctaggcttcagagcttagccagtagcttagcaagtggtattttctaggaagccactcagattagtgccaaccttctgcagaaatacagagctataggtgctgggtgagttgtgagcaaagccatgttcagaatatgttaagtttctattttttaagtgagcttatttgctgaggtaatgcagtttgcctgaggcaaatgatcatttagatcagctttcatcttttaagccagatcttgagatttgaggcgctaaactctttgcgtacgcattttacagctctcttacttggttgggatccactgcttcccagtatctgcagacccttctggggactgtgacctgcagggggttaggtagctgttttcaggggggcattttgagcccgacattcacgttttataacattagctgtgtgggggctggcaagaagaatctagccttttccattaatttagtgactttgttcattttaattttttagttaattcactgactttataattttgctaaaccctacaaactgctcagcataaatgatttcctttaatccctacaaaatgtcaggctcccaggcctgcaggctcagagtgtatgcagggcgaatgctgcttgtgtcttatccaggacagactggcctgtctcgcacctgtcaggcaactttactcctgatgctgctttctgggacgccatccaatctcatttggaggttttgtcagtgagcagatctgtttctgttagattcaattgaggcagaggcagacactgaggacagatgggtggctgaagataacaccggggaaaccagcctctaagaaatagagccactgcaattaagacttccactctctctccagaggttgtggagtcaacagaaaagcagatccatgtctgaagaccatgacaccttagaagcccagacagacgagagggaaaacagcctagaagaccttgccttattatttctactctagaaagatgcacgggatcaataaagtaaatgagctgtttcatccaagctggccgcgcagatccagggccacagagacagacagacacataaacgcattgatcaccctgctagggcctactggcctaccctgcatggaaaatgtgaatggaaagaaggcaaggaaaatacactatttgtagttctgagccacagctctgattgtaggtcacctcctttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaatatgtattatcgtctccatttttagataagagaattaatgtttagaaaggcaagttgatcaggcatatctgtgcagcaaatggtaagactcgacttgaactaaccttagacaaaaaaacaaaaaacaaagcaaagctgtggagtggcaagagcaaggctggccttagggacagcgggatgggggctcaggtgcagctgagaccctacccataccccttctgattgcgctgctggcttctccacttagggaatgagaggagacaatcagttgctattctgagtcatttcctgggtctctgagtaaaaaggagagaagcttcctctcttccagcttcagtttgaagagtctcaggcaagaacccggttggcctggtagagtcttatgcccatccttgaagcaatccctgaagctggaggatacagtcctaagggtcctaagttactgggtgccatatggtggtgggcggggtggggtccatcaccaaaatggagcacagagggagctagtatgaatcaggcaagcagttggctccacttccacatgagatggcagcaggcatcgctaagcctgattcacagcacctgggcttaagttgcagcaccgatacataccagctatgggactttagagagggcattttctctgtgtcttgatttccttcattttaaactgaggacaatcatatctaactcctgtgataattgggtgtgttaaatgaattaatgcattagaggagtatctaatacaaggtagatgcttcattaatgtaagctaatgttatttttaccattacttttactgttattataaggagctatgtatcttgtccaaggtcctgtaatagctaataagtaaaagagccaaaattattattattatttgagatggagtctcactctgtcacccaggctggagtacagtggcgagatcttggctcaccccaacctctgcctcccgggttcaagtgattttcctgcctcagcctcccaagtagctgagactataggcacgcgctatcatgcctggctaattttttagtagagatagggtttcaccatgttggccaggctggtcttgaactcgtgacctcaggtgatccacccacctcggcctcccaaagtgctgggattacaggcatgagccactgcgcttggccccaaaattcttatcagagttacagtgggagatatcacaccatgagctctccttctaaggatgcccaggccctgaattctggcacctacctcgcctgcattttgtaggttgcactgatttgcttagtggggccacagtcaacaggctctgatcaaagccacccttgccgcagctgacccagcagcctgcccagctccatccagggctgttagcccatcctaaaaaggccctctccttatagaccattgcccgaggaggtctttccaggccctacctcctgaaactcctctctggcctagtctaatatcccttatccttcctaactttcctaagtttccagtcctaacttccctctccacctgcaccttggacatgatgattgacactgtgacttgcttctcaaaatcagctcccctatcaggtctgttttgttctccgtcctgaagacagtggtcacgacctcgcccaaccctgggctggggctcagcctcctgctcattacaggggcagacgtgccctttgatgtcaggcctgaatagaggttccttatttattacaatttattatcctccgaatctgcctggggttttgatagaacctggctgccaacggcttgccctggcctttctgaaacctcaccatttccacaatgaaacaggacgcaaggactgtgcccctggtatgggaagggaaggaggagaagcttgcgtttacaagtgagatatccacagacagggaacatactacatttttttcttctagactagcctctgtggactagttcatcctccataaggttgatatttttttcccaaagcctggatttgcattgcctagagccacattcacggtaggagatgggtcttcccagtgtgactggactcacttcttagcactccctcggtgggtgagttaggctggaatgaagggaggagccacctttgggattgcggtgctgccctgggcacctcacactgccttctcttcctgctgctcgctggtgcatgcttagaaaacccagtcagcttgttttgacctaaagcaaaaaccattattctctgagtttgtaggtaagcttccacccaaaatattgttgtgagaccttggatttggtgatcttgggctagctgcctaacttctttgggcttccatttctgctctatcaggtaaaggattgggacagatgatcttttatggctataaacatccagtgtgctccaaggccactgccaaatatacgcttcaacaacgctaggagtggtttgcatgatctcctaggcttgggaactctgggagcagggattgtctgttctgtgcctggtacatgggggtcatttaatacacgtctcgacaactgcatagcccttttgctccctgagctgagaggacagaggaggatgttaacagtcactgtctcaaaaagccctgagcaaatctgctctgttctcagcacctctcagcactgcctccttcatgagtccctgctgggtgggtagggggctaattaagcttgagtttcaagaacttgtctacaaatccacttcaagggctcacatgcaaatcaggccctgctggcagccattaccatctcccacctgcagcccaggccttagaggccaggattcacaagcagaacaacacctgccctcctctgagagctgtgctgcagcccagggccacgtggacagggtgctggtgcattctccagcaacactgttgagctctctagtttgcagaagagtccaagggtcctcacaaaacctgtgacaactgaacaatcccaccattcttatatgatatatataaccaccattccatatgtataattatgattgaaaccgaatatcattcctgattgcagagtctccaagatggtaatttctgtcttagtgtattttccactggtagttttgtttgttttcctgactaacgttatgaaacagtattactctcctgttacagatgtacacactgggatgcagagaggtgatctgacacaaggacagcccatggtcaagcccctttgacttctgtctgctgttgaaaaggatgtgcctccctttcactgagcctcattgcaatacttgtatagattctgtgcccctccctcccttccttccttcttccctgcctgcctgcctgccacaggtgtttaatgaacatcaactatgtgccaggggctgtggagtattctagaaatgaaacaaggttcctgctctgagtttttatgttgacgagaaggaaagggtgaataaacaaatacattaacaagaaaatatcaaggagcgataagagccctgataattatttaagatgagactcaggaggcaaatgtgacttgagcagcctgccccgcctcctgtgtgaagaaaggcaggaaaacattccagcaagagagaatccccactgttagaatctctgcatgttgtcattagctgcatagatctgcttgttgaaacatgaaccaaaactttcaatcttggtctgcttgccctggataaagtgcatttctgagtcttggaccacagcttgggaaattagcagaggcaaatgcaattgtctcttctaaagtctttttttttctttttttttttttttgagacagggtcttgctgtgacccaggatggactgcagtggtgccatcacagctcactgcaacctccgcctcctgggggcaagtgatcctcccacttcagcctcccgagtagctgggactacaggtgcccaccatacgcttggctaaattttgtatttttttgtagaaagggggttttgccatgttggccaggctggtcttgaacttgtgagttcaagccatccaactgcctcagcctcccaaattgctgggattacaagtatgagccactgcgcctggccctctcccagtcttgagaccacagtggttggaagctttaacagaaaacattatatgtgtgtcttcctcaggaaatgtattttgttaaaaatctgtaacatgaagggaatggtaggaaagagtaggctgcttttgcatttaaaacaatgttaggagtgaatcgctttcctggtgggttatgttagaatgaatctcaaaccctcactaatatctttcagaggaattttggcaaatagcagttgtttcttggcctaattgaagtcttggttaatttatcccaataacaataacattaccagtatttgtataacaaaaatggtttctgactgtgccagcgtgggacgaatgagactcatcacaatttgttttagggatggagatttagaagaatgggtggagaacattctaaatggaatctatggacagggtttttattcttagtgaattttgaagaagtgacgtaaaggaaacagtttcgtgtaagccctggctcctccctcaggggcagctggacaagtcgagcagatcctggaagtaaaaggcagccccggatttttatttctgttttccctttcaccctaacaaggccgtgctctcctgctcatctctctccactgcctggactcctctctctctgccttctctctctgtttcctcccccttctctgtgtgcttccacctcccgctgctccctgctctccctgtctccgttccccatcccttcttgctctttgctgctgaccagctgtgcaactctgtgcatctgagggactcctctggacgtcagctgccacatctgtgttattgaaggggacagacacgggattcctattatggccaacgcagactcaccctttctgcaggctcaccaaggaacgaccactcagggagagtgggtctgacatcctgagaatcaccatgacttccccaaaccagtgggacatccggggcctttgactgtggctgggctgcctctgacgggcgggaccctgacacccaccttagctgtgacagttgctccatgcagctagttcctgggcacctgtgcagttccttccacaggaggacattctgccctttgccttctttgagacatgggtgtcttgcttaaggggaccagtttcccccacgtgcctctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaaccttacgtggttggggagaagtagatacacggattcattacagtgcatggcacattttatttttatcttggttaaaaaatgcatagcatagaatttaccatgttaactgttttcaaatgttcagttcagtagtgtgaagtagatccacacagctggaaaccagatctccagtgcacggcacatttttatgctggaaatacctctgttagaaataaatccttggaattgatacatacacaaagccgtcactcatcacaaatgatggaactagaaagccaaggcctattggtgtctaagagtcagcctgcccatgctcacagacctgcctggaaaggttttgttttgtttagaattttctttttatcaccatttcttcattactggaagcctggctctttgcagacaaatcgatatctccaaggttaaacaatttatttttgtatatttttcaggagacatcgagtccctgtaatgcaagcaagttgctcatttcctgcttctccagttctgtcttccttgtcccctcttcccctgcctctctcctctcttctcttaccctctttgttatctcatcataatttcttcacagcccaatttctttctttctttctttttttttttgttttgagatggagtctcactctgtcacccaggctggagtacagtggcatgatctcggatcactgcaacctccgcctcccaggttcaagcaattctgcctcagcctcccgagtagctgggattgcaggcccctgcaacacgcgccccccacccctgtctaatttttgtatttttatttatttttaatattatattctatggagtcatttcccaactagcatgtcttatgcttgaattattctttatacttaatactgcccatcacataaaagacgttgtcacgaacccagtgttgttggcagaattttggctcctatgatctctgtcacctggtgtcacaccaatgggtatattacagtacctggcaaaagagactttgcagatggaattaaggttggaaatcgtcttggattctctaggtgggaccagtgtcatgatatgagcccttcaaagcaacagacgaggtcaaagcaagggaaggactcagtgtgcaactggtggcttaagggaggagaaggcctgagaaggggctggaccctggcaccagcatgagctcggaagcaggttttccccccaccccacccccagagcctccaggaagaagtgcagcactgctgaaactttgatctgcaccgccccactcccaggccctggacagaaaatacagccactctatgctggacctgggacctatagaactatagtgggtgttgccttaagatgctcagcttgcagcaatttgttttggccgcaacagagcactcctacacctaccattcactggcagataagagcttagaagcaaggctatttattcttactggagactggcttttttttttttttttgaggcggagtctcggtctgtcgcccaggctggagtgcagtggcacgatctcggctcactacaacctcagcctccagggtagctgggattacaggtgtccatcaccacacctgtctaacttttgtatttttagtagagacggagtttcgtcatcttggccaggctggtctcaaactcctgacctcaagtgacccacccacctcggcctcccaaagttctgggattacaggcatgagccaccatgcccagccagaggctggcttttttttgcttcaaatgctttatgaccaaaactgtctatgtgcagggtccccagctgaagtggatacatattttgtgttcatggaataggaggaaattagttggcctttcagaaatatgggacaagatttcttcttagaaatgtgccctaagcaagtgaattgagtaaaagtgtggattctgagtccctgctccttgcagaggactatctggaaatcggttgcattctcaggaaaataattcagaagtgcagtatcctgtggaccactgcatatttcctgaatcagtatctttgtggatatgggaaggggatgtatgtatatgtttggtgagcgcccaggcagtacatacaaacatttgaaacccactgctgtgctccagtgttttttaaacagctggttgagacccattgaatcatgaaatcagtgtagccagaccatcgtttaaaaaaattagaagtgcataggaaagaaaaggtaatgttatcagaatgtcttgcaacatggtaaggacaagtgtgtttggtgaaacttttgtttcaatgtgtgtgttttcactatatgtgtctgcgtatgtgtgtgtccagagtcaccatgtaaaatgagcaggaatatttcagaagcactgctcttgtctgatcttgcaaatctcaagcctttgtcctggactctccaatgcgctgggtctctgatcaaccctgccctgaccacctgcgtggcctgccttgccttatggcgaccctcggaagagtcgagcaggcagcgcgtgcctggggctttcagggacacacttccttccattcggggacctgtgagtatgtcagtggaaatcatttttttttctttttctttttttattttttgagacagggcctcagtctgtcgcccaggttacagtgtgatcctggctcactgcagtcttcatcttctgggctcaagccatcttcccacctcagcctcccaagtagctaggattacaggcacacaccaccacacctggctaacttttgtattttttgtagagatggagtctcgtcatgttgcccaggctggtcttgaactcctgggctcaagcgattctcccaactctcccttccaaagtgctgggtttacaggcatgagtcactgcacccagccaaaataattttctattcgctggggagtaaagttgtctttgcatctcccgcacagatatacacaagaaatataggcaggtgctggctacggatgcatagaaatggatggcttcaatacaaggtttttggttgatgtggaacaatattaccgcatagataaagaagccccttcaaaattagctttaccaatgagatatggtaaaaaaaagaagtataagtgatgaaaactaaagagacatatgactgtaagtgttaagacttgaaggaaataataaaagccaaactgcatctctgattttaaaatatgggagtcataataaatcaacagaaaggataaaggtatgctgaggaaagccaaagaggagtgaccactgttggtcaccaaactgctggctatttgcagaagggcctgaggccctgacctgagacttgtgctcaagtcagcatagtttgggctcattggaatatgtgatgctaacgatgtcccccagaagagtattttgttcctttacgcactttttaaaataatcatctgtgatatgaaaatttggactggtcttgaaggaatgagtcctctccttacccaggtttctttgtgatgtcaggcaatgatggtaataagaatggtactccagtactaggagtaatacggtactttgatagcgcactaatgcacagcattggcagaaggctcatggtggatgtgaaattaaacgcttcgtataacccataggcgatgttgttgtctttgtcatggacaggggagaaacatgaggcccagagaggtaaggtgagcactccctaatagtcagcattgggtgaggcaggaacattgtggccctgagtccctgagattcagggcttttcccatgaagccaacccactggtcactgagtggtttcactcctttcaccaaccaggatacttcagaaagcacttggggtgacccaaagctgggtccagatcaggggagtcggttgtaagttgtcatgacacttcatccttacagaaggtggaagttactcatttctgttcaatgagctttgaagaacaaaaggtcactgctaatttgaagattaaacctttataccaacaacatcctccaattactatagaaaatttagcatccaccatttgctcaggaagcaaagaagtcactgttgaacaaactctgaaataaccaaggcctccaggccccacacctcttttaaagtgctttcatgctgaccatctttttttttttttccttctatcttcagcccctaaccacaaagccaaaaaccacaagaaggcagaaaagtacaataaatgggttttctctacccatccccagcaattgtttcacagttttattaagttggggattcttggaaaaaaaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggctgttgcttccttttcccctacatcaaaaccttaggtttgcttcaggcttatggccttggtcatcctaggagtcaccaacttgctatgagaagctggcctgattttgtgtcactttcatctttgtaaagtataaacacaacatgtgaagttgttaattttcagtgcactgccccattctgtagcgttctactttgtaaatgacattgagcatatacactttccaccattgtagtaagcccaacattcagtgaagacagatgcctccatttatttaaaaaaaatcaacacattattaattttaatgcaatttaagctaaaaatgaccgacaattcttggtttaccaacaacctcttttaaaaattgagactctcataagaggatttcggtttaaaaatgttgaaaggtctttttgtatagaaacagaatgaagtacaggatatatttaaaatgtggctaattaacaaaatatttgtggtggctcatgcctgtgatctaagcactttgagaagctgaggcaagtggatcacctgaagccaggagttcaagaccagcctggcaaacatggtgaaacctcgtctctactaaaaacacaaaaattagccaggcatggtagtgcgcacctataatctcagctactcgggaggctgaggcataagaatcgcatgaacccgggaggtggaggctgcagtgagctgagattgcaccactgcactccagcctgggcaacaacccgggagacagatagatagatagatagattctctctctcaaaatatatatataaatatatatatatgtataaatatatatatctatatataatatataatatatatacacatttatatattatatatagatatatatttatataatgttatataaatagatatagatatataaataaatatatataaatatatagagagtatatatatgtttacgtatatatttagagagaatatatatatatattcgagtttatattattatttttaagatttcaaaagccttcccttaaacacttagatccatgaatatcccgtttttttactaatgtgggcgatgaaacttcaaatgacttgggaaaagatattctaggaatgacaatctttttttaaaaaaattcttgctaggaagaagtatcagaaacctccatgttcttacccatattttcagtgattaacagtttcttgtgatgcaagttttctccacagtttgtttccagggttacaaatccatcatgcctaccttttcaaaatcacattaattcaagttcacattatttttatcagccatcaattaaatattaatcagcttttcttggtctttagcctataggtcttacttacaagactctttaaagaggaaatactagaaaccctgccagttcaatcccctggcttggaataattttgtcagcagtactgactcctgtagctatctgtgttgcttaacttgcgacttctcttaagtggaaagttgaagagctttaagagtattaacttgctttgtttccatattgacatgatcaacaggctacccacagatctgatgcatttcaatgcccaaacacaagagcatgcccctggaaaactgctgattctgagttccagtaaagctttaagctcctgagattatgaccatttctttattttggttttccactcgtagaaactgtctttcagataagagaggaacactactgtccagagagtggtgacaaggcatcatgggagaggtgcttaaaagtctccccaaccgccccatcatacttccttgcaagagccagctctggtgtcagaaattccctagtgttctgctggtttatgtaagacatgaccctctccaatgtgaatgcctctgtagagagagccaactgatgacggccttaaataaagatcctgaaactcctgtcctcttcattcagccagagaggagctgagctcacagccctaaactattcatttctaccaatggcagaaagtgtatagcccatttttatatgtttaatatgtaaggcagcataatattagtttatacacactcatttggaccccttatctctctgtgtgtgtttaatttgtttcttttgccattttaaaaacacttgaggtgtggtgcactcatgaaaatgcatctccctctttttttttttttttttttgagacaaagtctctgtcacccaggctggagtggttcagtggtgcaatcttggctcactgaaacctccgcctccctgttcaagtgattctcctgcctcagcctcatgagtagctgggattacaagcatgtgccaccacacccagctaatttttttatttttagtagagacggggtttggtttcaccatgttgatcaggctggtctcgaactcctgacctcatgatctgcctgctttggcatcccaaagtgctgagattacaggtgtgtgccaccgtgcctggccgaaaatgcatctcttaatggtcttgaggactgagccccatggctggcagtctgggctgtggatgtgtgatcctgcttgggtttaggaggatgaacaagctgaacttctcacttaggaaattgcaaaataccattgcacactgaaacctgtaaatttattttggaataattatggattgctaagggggacagaaattaaggccataactctacaaattgtaaccaccaggattgcctaggtaacagctccaagatctccagggctccaagaagaagcgtttatttctcagtcttgccacatgcccattgctgacctaccagggggctctgctgtccccctcctcatgctggttgccatgccagaggaaagagagctctggaaggttttatgtcggggctgttcaagctgctcatgccaaagggatgctgcttccttctagaacctgttgacaggtcacccagttccttctggccatagcaaccaggaaggataatgtaacatgtgcccgggggaggtgggctggaaatgtttggcagccagcactgctcacacacagatgtcaagagatgattttcactggacagaaaagccagcagcctttccggaggtgaagtatcctccgtcttcatgactaggaagaggctttgtgctgtgtctctcggtgtgctattaatatgtgagccagtgcattgccctaaccatcaactccatcctgcttcctcatcaagagaaaaatgcaaaaccacctgctgtgggatggagaagaccagcgcattcccgaggaggcactgctttcccttgccctcacagcctggcctttgaatattctcccagaaataggttcttggttctcattctcctttcctgagccctcctttctcacttctcttcccactctgtgccctggagtgccttcctgtaattcagagctggtgttcttttgggggatttctcttcatgattgagatgagactgtctaaggggctaatgtcacccatttcagaattcacttcccggataaggattcttcatagctgtgttaagattttgctgttgttgagtccccagctggctagtgctcttggcctccatcacttttctcttcctcctttcttgccccctttggtttcatgaagctgattttttctcaagtttcgactcttgcctctgagccaccttttcagtgcatgactttcactgccctaaaataacctatagcaagaaaatcccaaaagaacagtgttcattcactgcttctaagtgacaatcagaacttcttttaaagacagcatattattataattcattacaatgaaaaacagaaggtgcctgggtgagttgaagtaattgtttagttgtggctcctgatctttttaaaaggtctgcatgtgaactaaacactctaaatatgtccagtccctcctgtcaaattcctgtaagggcagaatcacctcggggagtggttcttccggagtggtgattgacatgcaaaatgctgcgcagagagcctcagcattcactagggcgtcttccttcctcccctcctcctttccttcctccatgactgaaggcttgcgtggttcccacaccctgctgggcactgatcaggttctaagatctgccttcaaggaacccacagcctcatggagagaacgacggacaattaggtcaccacaacaccggatagaaaccccacaggcgcagtcagtgcctgcctggctcacactttcataccctagagccaggactccaaaaccatgtgtccaatgaatcactcagcaccgggactgtcacaaaagtgagtgtaaagaactgtgggtcattccctctgcatcgtgcatttctctgacaggggccctgcactatttgcggaggcatctgtagatttatttcttaattgcctaaaccactctgaaatacctgtccattcccttagcataagattaagtggataatggccaaatctctatttttctgagtagccaaacttagcggtcagcatttagcctttatccacaaacatggataggaagccctgcccctgggcatggcagacgggcaggaccaaccaagaagcagggaccagcccaggcacagtgaggaccctcagcatcaggcaatgattttgagttgagataatggttagtgtctgtgtttctcagagcaggatatgctctttaatctaggatgcaaagcccatatgaggtaagaaaaagaatgtagaaccatttggaaaacacccatttttcccctgggaggctgagtaggtcagggggatccgctggcagggggtcctctccactcccctctgattcccagaggccgagaatgtcgtgttcagccattggttactctgtgctgcacggtgaagtctgtggttgttggtaagcagcgtaaaagccagggagtgtctgctgcaagaatccctgggcatcacgttgcttccgacactggtctgtgtgagtcccacagacgtcctagcagctgcaaggggcacacacctccgacctccgaccggcaggtatgaatgcttccaaagtgcccggagtgaacagattaaagcaattttggagggtgagtaaaaggatacaaatcaacttactgaacaaaaagaaaaagtttaatttctggaaaaaaaaaaaaaagtagctgacctgcagtctgagatatgctgagagatacacacattatcttacaaaatttctgcggggaggttcagtcgtgcctgtttgatgccttactaaatgttgggaatctaattttaactgatctgcagcagaagcaatcagcagccagctctgtgttgggtgtttactcagagcaaaagttttctgggaaaggcagtttagcatctgagccacggtgcgatggttagccatatttatgaccactcatgcatcaaccagcatagtctgatcttagcctctgggagccgatttaagtcttgaatgtgatggctaatagatagaattctgaaaatatgtgtatatatgttttccttcagactctctagtctctcagaagccctatctaactagaaggacaaaagaaaatctcagtctttgcattgtactgttaaagcattagaatgtactaaggcaattgtaatcacaaagcattcaaatgtatggtatgcattgtaggctattaacataatcctgtgtaatgagaagatcagcaccaagctagcctaatggcagacagcttctgggatttcaatttttgcctggattcacagaatagtaaaacctcttgggaattcattgcttttttttcagttgtcagaagctaggctctgtgcaacaagtaaagaattctttcctgaatagttattctacttgggattcagggagatggtaaatgtccacgctgggtatcaatatcagagtccgttccatcagtgcttagggtctagaaaggaatggatgatcctgaagccgatgttcagtgatccctcacacttgtaatgcagggctggaataacgtgatgggtaggtttccatcttggttgaacattttatgattctatggttttctttcaatgctaggattgtcatcctgatcgttagaaatcactttagtagatgaataaacagcaagcagtgagcgcatctaatagatttctgacaatagatcgacagcttttctttctctctgttgctctaagtcatttgagaaaagcctggggttacagatattctttgtcaattacttctggaatccccatatctactcttttaggcttttaaagatgagataatatgagtatgctagtaattttgaaattacttcttaagcaaggttctgcattcactgggtagaaccaaaataatgcctttccaaattaaagcatgtgtatagtatataagcgggtatttcttctgagtaagcaagaagatattaaaaacattgaaatgatggaactctgcagaagaaccatatgacgcatgcacaactctaggctgcattgggaaaaccagccatatttgggtttgggattagcctcttggttttgtgcaagttgcttagtgccctgtattacccatcagtgaagtgagtggttcctcccagctctgagatttcatccgaacagcatggaaaacagtagatcattttcaccaaatatctgtgtagataggactgggaacatctgattaaatgtgttgagtgtcacattttctagatgttagaggactctgacaatgtcttgttgaaatcatacttgggtctggctctggactctaaaaagctcttccttaatgacatcagttgtgatggatcagagtcacttgtagatatggtgatgaacaaaagactagtttttattttctctttcacagatgaaaccttattttagccactgacatctccgaatgatctgaaaatgtattgcatacaacacctcaaagtttcagatggacactccctcagttgtatttggaagggaggccccaggggccccttggcatcctctgagagatgttcctgcagacgcacaatgcacacaagtgcacagaggcaactgacttggggtcccaagctagtagcacacaggcatggcctgagtactcagaggaggactccggtggatatgagcagacacccagggtttcacttgtcaccaacacagtccagatgatgaagcaaatactcaatactccaaagaattccttaattatttaggaaatttaaatgggtgatataattactcggttgtctcaattctgaattattcattctgtttttaatggtagtttgatgctagtaactccaggctattattaataattttttaaaaaatcagaagtagattagaaaacagtttcagaggaaggatttaaaagcctcttaatggaggagtggctatgcggcattgcattcaaacagccacagctgaaggctgactgggcttcctccaggctgtcctccttcctgagccagttcccgtttggagtctgggctggagggagctcctggcagtgccatgactcagtctggtgaaaaagcctgtgtgtgttcaggctgactttgaaggaagcacctctaatgatctgcagccagggtggctttgaagatggtaagcatagaatttcaagaactggactttgggtactcgtatgaaatggaacattattataccactaatttgttctctttaaaaaacagtgagagtcttctcatggttttggtagtctctatttatttatatatttttattggtagcaagtgggaataagagcacagttgtttaaacaaacccaagaccattctacttgctgtggctggaaagtgaagagtattggaatcactgttttaagtggctttgctgtttagactgaatgtgcacgagagccaaatgactatttgatttcactagaaaaatctgtaaatctggttattggatactgtataaagccatttaattccacaaatgttagcccacagaaatctgtgcactggaagagctcctttaaatttacaacagcaagaaaaataggtttgctttcctatatactctctactgttagttacaatgacatgaaacaacccaagtttgaatatttaagagtagccacaatcacgaagggcagtgtgatagaaccgagcaatgaacaggatgtaagaaatcctggtttaatcctatctttcctatggttttgcccaaagtggtcacttctcctccctaagcttcagtttttctcacctgtaaaattggggaagagggtgtagatgaaatcagcatgattctgcatgtcagtagtacattattatctcctagaaagctttaaaaaaaaaacttctgatgccgagactctaacccactctaattaagtcagagacacaatggatgaggcccgggatatcaatacatgctcaataaagctcaccaggtcattctaatgggcatctatctaaagttgagaacagtagaaccgtctgaaggtctcttctggctccaacattccgtacctgaagatgctaatggctctttctcaatgtcagagcacgatgcagatcgtcttgtggtcacggtggttctcttgactcttctggtcacgcgtaaagaccgggagtggaaggcagcacctcagcagatccaaaggccatgaacaccccacagtgacttcccaagctagagactgtgagtgtacttggtgtggacaaggcattcgggaaccactgaattaaatgggatatttttattcttaagagcagtgaactctactttcaaggggatgaaacaagtgaaaaaaatactttcccccccaaatatatttgtcttggctacaccgaggtctaatcagattttaggtatacaaagattaataagacacagtccttatcttaataagacatagtccttatcttaaattaatttacaatctagtaggggtgagggacaaattacaatctagtgggggtgagagacaaatagtaactgtgtaatgtgggggtctctaagtctgatattgcttagctatgcagttttctagtctcagaaacttggctaatgaattcaaaactggaaggaggacccctaaccctgtcatttgcccagttaaggtagttgagttttgcgagtgagcttttcattatgctttccatacatatttctttgaaacacaaaggtatctaataaacccacacaaccccacacctgtacacacacagactctggtattgcgaagtgtttacactgatgtgcaacaagcctctatgtacttaaatatgcaaacctatatttacatatttcgataaaagaacaaaatacaataggatacttcatcagtcatgacacaaaggtgaaaaccactgttaactacttgtgaacctcttattctatccttaagcatctggaggcagcttgtgtattagaattattgagcctccgtgtcccagatttgtgtcagaacctatccttatccaagacttcttccgaccagggagagaaacaatagcctgggtgtttgtgttctttgcagctctgaccaggtaagactagttgtctataggtctccttcttgcgttctgtgggtctccctgaaaccattttctgcaggttgttaggaagtagggaaggctattttaaaattgctaatccaaagaggaggtaagatgagatcgtgatacctttttccccaagggactaaccacacaaccaaccaaccaggatagtttagtagaagaagcatcaacagtgctacaaatcagaatttgaatttgtatctttccacaacctagctatgtttgcttaggcaaatttcaacctgcctgaatcagatttcctccaatttaagatgaagctggtaatacccctacgtagtgtttgggggtgaagattaaatttaatattaatactgtttatacagcagctattaaaataactagcacatagtagatgttcagttagtggtgtccaaggtggctgataactgtcatgggagactgagtgcaccacttagtaagatgtttgttccgccaactcagtctctatgaagtagctctgtgtgatgtgggagaggtcatggggttgcagtggtacatttggaaaaagaaaaaatactacctcttagactcttaatggagtaaatggtgtcattgcgtagattctcattagccagttctcccttccctctcatgccgtgtctctggggttgagaccagcgaggctatctttgtatttgaatctctctttgtggtctggcttgtgtttcagtgtatatctttccacacaaaccagatcaactgctttcagctctgggaggaaaacaaagaaacaaaatgtgatgcagtcaaacaatttaatttctcaaagctttatgattcaaataaccaacaacattttacaatgagtcattttgatggccagtaacaccacccatggcttcttctttggccttaaataccgtccttttagagaacgttcttagtttctttttaaccaacagtcaaaaattattaatttggctctttattcatgaacattaaaagctggaagttaataaatattttatgattgtaaagctccaatgcatatctgattgatatggagggataaagaattgaaggcaagagaggcctcctctttccagaatttgcaaaatcaatataacttgggctttcactgatatactaggtgcatgactaacattggctagagcaggtgctgtctgatggaatggcgctgccaggaaaccctgatgctgccccggggaggtctccaggtgagtttgatcattgcatctttccctagtcttccaggtgaggttggctagaatacccaggggaggaaaagagagcgtttatataacaccaccagcccctctagtaatgtcaagatttgagagaagtatctagtagctcttccttctcaaaaggtgatgggttcctgggctgcaatgtatttttgaaaaatcatatctcaatcttggaataataagcaggcaagtctgtcagttaaaaggtacttaagtatatgatttaattcatattatgtaatttttttctgcaaatatgttcaggaactcagctgcagtgttggtttttctttaaagatttttttccctttcccctagtgaaccagaacagattcttggagcttgctattgattacgcagatggatgggtctttctgagctaggaggagagaactaggataaatagagtccattttttttccaaaagcctgaaaagcccatgaattcacctggtattctggcaagagctgttacttcttaaagcaaaaagggcattgaataggtttttcataggatggcccttcaaataactactcctagccaacaaaatattttagaagcttgctttgccatgtgctcttgtaggaacctagaaaatttccattatcagctgttttcaaagaaaatatttattttctttttattttataaaaggaaaagttaattcatgaaatataaataaattctcagattggctattatttgcttaatagccaataataaaagagcaactgctattgattgcagagaaagtcagtgaacaactttgtgaatcaggggtctgttgatagcttattgttaggggagtaatttgcgaggttgagatcctatgctctgactgctgatgccattttctgcaaacgttgcctgagccaagtcactgactggcagggcttgtgtatgtgaaatacaaacatacttgtaagatttataaacgattacatggtcacgggcatcttaatggaaagaagactgctaatcattgacattgaatatgtagagaacacttcttttgtaggcagatagacttattaaggtatcttgagtagttctttaatcaccctgtctctgttgccttatttataaaatagtgataagattacttaacctgttaaaattttgtgagaaataaatgagatcataagtgcaatgtgcgcacacaaggcctgtcacttctgaaaaaaatgttggtttcccttttccctctgtgcagaccagcctgcatttaccctttagctgaagcatctaggccaaggatgtgtgtgctcagtgcatagctattgaatgaggaatgggtagaagattgattgaatgaatgaatgaagctagcttatgttcaataaatacctacattagcatttatgggtgaaccctgaatcagttaggaatgcgtcgagtctgtttctaaccaggctgcctcattactgatattaacatttatattccctgaaagcatcagggaatcaggaaaagattctttcccatgttgtttctgttcttacctggccttctttagggacatgaacttcaggtagttctggctattagccactgtacatagacattacatatgcattgtttgttattctcctttgaatttaagattgctctttgactaagaaagtagagtgtttccactctataatttatcgactaagaaaaagaggcaggagaaaaaaaaccacacacaagacaaacatttaacctaaggctttcaggggacaagtgctggtggatttctgtctcttaatgcttgagtattttcctgttttagctgcacgagtgatgaaagtgaggtgaagactgatttaaaggcaccttttagttcaagatgccttgtcttggcaaagattttaagatgaaacaaggtctccgactgagcaggcagttatcattaaatttcgttttcccattgaatttccattttttcccaattgtacaacgtcttgatagcatcactgattcctcatgaaaatacatattttctacttgataaagccacctacaaataacttctcccatcctccaaatcccacaaatgtgatccctactacaattagctaacacctagtcactagttaatctggtagaccttccagttccttcactgcctcttggttccaggtattgcaccagcactgcagaggcaattagggcagaggccttaataagaaggcctccactgaacttaaagccaggcatagggaattcgtgaaagaaaccatagtaaggtgtgagaattgccagattaagacagggataaagtactcttgaaatatccaaacagaacacttacttttgcccagaaggcagaagcttgaggaaggccacaagaaggagatatttcaattagatgcttttataaatgaattttaaaaatccccatatgggtcaaatgaattctaagtgaagaaaacagtgtggtctgtggaatagaaatacggaattttatagaatctcgtgcaaacaggaattattttactccagctagtaaagcaggtgtttgaagcaggtggcggggagttggcatgagggtggccgtcagtgaggccagagaagaccccaggccaggtggaacatgtccctgttgtacggaagtccagagctagtgagctgatgctcatgcatcatttgaaatagtaaacatggaaattaaggcatgtgctgttcagaaggctcagtaaataacatgtggagttaatgcttcctgtatacatgtagacttaggtaagcaaagcctgaggttcttgggccttttcacttgctattgccatggaagagccaacaaactatctctctcagttccagcagtcctggttcatggctatttacatgcaaatgtcaacaccagattgaaaacatcagagtgattttgctataaataaaaagtacattagacttttagattttctttgggatctgttagtgagcattacctgtgcgtgcagacctgtacaagacatcttggaagtgataggaaaaaacagcattctcgtgtgtagtagatagattcctattttcacacccttctctagatatctgtcagatgatcttatactcatatttttgaggaagcaagagtgggatatctgttagagccccatttgggcaaagagtaaatagaggggcacagtttttatggaagcctggaatgatggattacattttaataaggagagaaatttggttgcagggatacgaataagcaggttgaatggaggggcagactgggaggctgagtctcaggaccgcagggccagagcagcacctgcaggtgagaggtctgcagagaatggcagcatgtttggagtgcatgtgaggcaggggcatgggggcttagagtgctcctcttctcatggtgggctcacatatgtgatgtctacttgtgtttggaagcctgggtgacaggtagaccacctgtgaaggatggggaaagagattcctcactttagtagcattatcaagttcaagcaccagtatggaaataggaagaaagcaaaagtatgtactcctcccggctaagcaggttgtgagaatcccagcatccttgcacaccctgggatgcgctcaccacagaggggtgtgcgctggtctcaagggaaaaacagaagcaggcctttttgaattgaagtgcaattggtgtaatataggcaaaatagcaactcttttcctaaaggaacatatcgtgcccaattttaattagctctgatgaagtctaggaaaatgggtgactcgtcagagaagctgttaaacttcagagaaaaactgcctatagccccaaggtattccttactttgacaaaattcttatttttccttaagtgtttgtcactgtgaaacccgtcccatttccaggtgccgtcactgttggtatagcttgaaaaagcaacacacttcctatggtaagggcagcttatgggtgtttgcaggtgcaaggcaaagagacacaaaaatctagatgtcagaaagaaaatataaccagggggtgaaatagaagggaattatcataaaaatcaagatgaattggtaatgaatcagatgcatatttttttctctttttgaacagttttattgagatattaatggcatacaacaaattgcacatattttaaagtgcacacattaataagctttggtgtatgtatacatccagaaactcacccctcaatcaagatgctgaatgtgtgtgtctctcctgagagtttcctccacgccctctgtgacacctcacctcgctcctcccaggcagccagagatgccctttctgccatggaatgtttgtgtgcatttcctagaacgatacataaatggaaccatataggatgaattctttcgttgtcagacttccttctttatcccttccaataggcgtatagcaatatctcattgtggtttcgttcgcacttgcctagtgagaaatgttgttgaaaagtttttcgtggacttattcgtctctcctctgtcttctttggtaaaatacctggtcaaatccattgtcagttgtataattggattttgtcttgttttattttgttaccatttaattttgagagtttcaagaaatatattctggatacaattcctttgacaaatatatcgttggcaaatattttctctcactctagctcttcttttctttcattctcttaacagtatcattagaaaataaaattcctcattttgatgacgtccagtttgccagttggttctcttatagattatgcttttggtgactgcctaggaaatctctgcctagtagagagggtcacaaggttctcttctatcttttttttctagaagttttaacatttaggtctgtggttcattttgagataattgtatattgtatgaagtacgggttgaagttcattttttctgcatatggctatctagtcattccaataccatttctcgaaaagacgatccttcctccttgaaatatggcagtaacaaattatagcacatgtgatataaatgacttgcaaagccacacttccaacctgcattaggaatggacggttacaagggccgctccaggagcccacctggaggaaaatggaaactgccattggctggcagcctgttgggtaagaatggaaactgccgttggctggcagcctgttgggtaagaatggaaactgccattggccggcagcctgttgggtaagaatggaaactgccattggccggcagcctgttgggtaaaccgcatcaggctgcattcacggatgctcttctgtggcactgatgggatgactccaggaagtctatggggaagtaccacaaaatgtggaggaagatggcactagacacctgaggagggaccacatgacctccatccaggtgccaaataattacagttgagatgatttccctgcctctactaacccaaattcacccaaattcattgtccacgttggtgttaggtgatatttccaaaaaattctgttatgccactcctttgaaaatttcctaggaacctcaggtaggtccttcttcttcagagttctagaggacagcagtgtgtccttgcactccctgccatcttccagcaggaccctgtgctcagccctgctttccacctgtgcctcgttcttacatgccttgtgtgagggatgtggcttttccctttttcggtttggcaaacaccttctcccttttcaagaccctctctgaaaacacctcatgtactcctgttggtattagcccctcttactttgtgccaccagatcagtttctgtctctaaatatcattttcgctccatcggatagaataactgttcctcctctcctctctgttctgtgtttccccacagagctgtgatggatggaggcctgtttgctgttagatctgctacagctggaatgtaatcttgcttggagtaagaacttacaaatgggccgggcacggtggctcatgcctgtaatcccagcactttgggaggcagaggcgagtggatcacttgaggtcaggagttggagaccagcctggccaacatggtgaaaccctgtctctactaaaaatacaaaaattagctgggcacgttggttcacacctgtaatccaagctattcaggaggctgcagcagaagaatcccttgaacccaggaggtggaggttgcagtgagctgagattgtgccgctgcactccagcctgggtgacagagcaagactctgtctcaaaaaacaaaacaaaactcacaaatgttcatttagtgaatgagtaaatgaattcagtgaatttctgtgttattcatactcatcctactttcatggagtttttatgaaaaggatgatgaccttcagccatggggagcattgcactgcctccttccaaggaccacctgggctccctggccatgagccagttgccccaaaggcatttgacttagattaacctgaaaacatcgatgtcatcatccctcagccctgctcagaaagctgcagggagccttcaccctttcaggaccgaggccaagctccccaggctggctttatacatcctctaacagaagctggccctatcccgtttccacttaattgactcttccccatgggatactctccttaattaaaattcatctctaccccctaataagcgtatgtgttcctacctccatgactttgcaccctgaaatgctctcagattccagtaaaatctcccttctcctctttaatctccaagtttctatgttttggggctctgagtctcttctccccataaagtctccctttctgaatttccagcctcactgcccactgaacatctaaccagatactgctttgtgtattgagtttgatggtataattagatggtgtatatttctgccacccacggcacagcctggtgaattgcaatctttattcattgatattgtgatagcagtgaacttgggtgtggggaaagtttaatgaaggtcaagcagaagatatgtaaagctctaaatacagagagtgatgatttattcagagaaataagagaatccatggggaataccagactctagcttccttgtggacaagaagcattcctgtgcctctgtgtgctctgtgctccttctccctaactagatccccacccttgccctagcttggtgcactgataccatacgtcgatgcagacactaaagagatgacttccacctcctcacaaatattcaggtagaagaccttccctcggaacacccggtcatcagagagtgttcctgatttcgcttttgcaaacaagaggtagtccagcttggaagaacatccagcgccttccctgaaattcatctgttctccactttccactcttgactgtcataacaaaggacagttgtaggtggtgcccagtgacccaactcagtcagctttatctattggcaataaggtagtattgacatatcaatatttccttgccaagatgctcatttgttcttaataagaatcaataatgttcaattaatatagattatgtcactaagtagttaatttagaatgtcgttgctttgcagttcatatcctaacccacctgatcctaacagcatccacctaggagcccagaccgttgggaaggagaagagcagaaaacctaactggtccacctggaagacctagaatttcattccagcaggagcggcccacccaggaaagggcctccctcccacagcagctgctgggaatcactctctttgatgacatcattgtcatctgggcagggagcagaaccattttggggtttcccatccattcagtgctcccactgaggtcttggagtatggcccagatggctgtagatgtgcaaacttacgatcatcctggagcacggggccctgtgtcatatggatcctgcttgatgtgtagatagtgcattattttcctacttgagctctttccttttccaggtacatagacagggttgccttgaggcttagtcacccttcgcccattctgtcttactactacagagggtgagagactggacaaaggggccctcagtgtaattttcacttcacatattttattattattttttttttgagatagggtctcactctgtcgcccaggctggagtgcagtggcgtgatctctactcactgcaacctccacctcctgggttcaagtgattctcgtgcctcagcctcccaagtagctggaattgcaggtgtgtgccaccacacctggctcatttttttgtattcttagtagagatggagtttcaccatgttggccaggctggtcttgaactcctgacttcaaatgatctgcccgcctcggccacccaaagtgctgggattacaggcgtgagccactgcacccggcctcacttcacatattttaaatttattccagtagtctaagcattatgcaactctggttagataatgaaggtcatgatacacctagaaggttacagatttcaactggattaaccattgttatacaaacatatgtgcatgtggatatcagaggattcagagcctctctcctctgttttgtaaattgaccttcagtctctcatcttaggaatgactcttggccttggatgagggcctgacgagggtgggttgagttggtaaaacccggctgtgttagtttccagtccatctgaacccacagccccttttcctggctttccctgctatagcccatgaacacaatcacagtttctgttgatcatcgttatggtcctcccaaatccttcacctgggctattggtttactagggttttttttttttggtggatttgcccaaatgtggggacacctggcaggagacagcagctggggttcctcgaggctgcttggagccctggcccctgagtcaagtcctcacgttcccttttatttccttctcccctaattgcaagtcgtcaggagtttcaaatgcccaccaacatttggagaaggcttgtgggctgtttgcaggctattcagccccaaaggctgtacggagataggtgtgggttatcctaagcgtccctgctcctcatgttgtcactcatccattttcagtaggcgctgctcctaaaatgcacgttaatattgatgctgtttcatccgggttcttttcctttctacattgcctcacctggtttccactattccctagtaactaggtaggagtcatttttttagatgaataattgatttgcttaagggactttgggcaaacttaattggtagctgagttagaagtacacattttgttcatttatttgcccgtcctttagatattcatgaagaatttgcatagaagcctagcactgagtttataataaaaattaacctcatggcatctatactctcagccacttttttttttttctttttttttgagatggagtcttgctcagtcaccaaggctagagtgcagtggtgtgatcctggctcactgcaaggtccgcctcctgggttcaagtgattctcctgcctcagccttctgagtagctgagattacaggcacacaccaccatgcccagcttttttgtgcttttagtagagacaggttttcgccatgttggtcaggctagtgtctaactcctgacctcaagtgatccgcctgcctcagcctcccaaagtgctgggattacaggcgtgagccaccatgccctgctttctcagctactttaaaacaaataacaacaaaaaaatctcctgattgtcagtgcagagccccgcccgtaatgcctggactcacaggctgctgggcttagcagtctcctcaaccccagctgcacaatggaattactcggagcttttaagaaagaaagaaataataataccaattcaaaatcaaacacggaacacatacatcggtcatcagtcacataccatagattcttatttaatcagtccagggtgtagcttggctttggaaggctttttctttcctggctcctttttttttaaacaattttttattgatgcataatcaatgcatatagttttggggtacatgtgataattaagtacattcatataatttgtaaagagcaaatcagagtacttaggatcttcattaccttaaatatttgtctttatgctaggaacattcaaatgattcccttctcgctattttgaaatgcacagtagatgagtgtatgctgcagccaccctgctgatctatcgaacgctagtgtgcagctgagggtgagaaccgccgggtggagattggaggagacctgagtctttaataaacactgagccgctggggaaaaggtttgaggggcatttgctaacacaaatgctaaaggtcagtactaaaaactactcaggccattcttaggcatttttgtcttagaaaatgtcaaaacagctgtgacctcatgatttctgtctcgtgaggactctgaagaatgccttagtgctcctgaattaggttgtaaatattgtacttttttctcttgagttttctttggaagaatagtgaatgattaaaagaaaaccaaagcagtactattattttagaatacggaaatgcaaggtagcaaagtgtctaacacctagaaagttagccccgcctggacaccagctgtgaagctctgtattaattgaacaaatgctgtccaagaaagcaaaacttcctaatctcttctgatggtcctcaatataagattagtatagaatcttcttagaattggtttcctttaaaaaaaaaaattgtgggcttctcttccccatcaaaatgacatccctttgagattaatgcaggaagcagagggcacggtggaacttgtctcgctgaatattctgacgtggtcaagtttcctaatcaacagcagagatacaaacttgcattatagttgtgggtggtggggaaaggattgcctttttttgttgttgtttttttttgagatggagtttccctcctgtcccccaggctggaatgcagtggtgcgatctcggctaactgcaacctccgcctcctggattcaagaaattttcctgcctcagcctgccgagtagctgggattacaggcacctgccaccatgcccagctaattttttgtatttgtagtagagacagggtttcaccatgttggccaagctagtcttgaactcctgacctcaggtgatccacccaccttggcctcccaaagtgctgggattacagatgtgagccaccacgcctgaccaggattgtcctgtaaaagtgaatttttctaggcaattgaagattgttaaaagtgggttaaggcttatgcctacctaaaacattcattccaattagggcctcatccacatttaaattccagattctgaaaacccttcactcctaaataagaaagtattggggcagcaggtcccacgccggactgtggaggttggctacgtgcagtgaatgagtcatttctgtaccctctagtgtatgtgtaaggtacagctgcagatagatccataggaaacagggactccaagaatagcagttagtaaatccgtgatccgtgtgtcatggttctattgaaaggaaagtgtaaccacatcagtgggtctgcataccattgaaaagagtttctcaatcaaaaacctaaacacatgtcctgaaaccatcacttaagcactctgagatcttgatccaattacctaaacttcctagatctgttttttaattttttttgttaaatcattgcaataattcttgtatcacagagttactccagagattaaataaggcagcgcatctcaaacacttaccagtttttgttaaattaggacctttttcacccactacagttagtagtacctaaaagtggagctacgactagttttcttggagtgagttttgggaatttaaataagtaaatcgtgtgatggagtttggaagtgataaagcactatataaaatgctcatgcatttccccatttcccaaatgtccatggcatgagtcgtgcattccagatgcctggtgtgttctgggaatgcaaggctggccatgcgctgggtctctcctcatagggtttacagtcagttaacagcaatgcacacaaaaggatgtattgaaatagatccattggaggagtaaaaatacggtgacaataaggggacagagaagaaaacagacaaccatggccagctcctaccggaacagtggtaaggatgccgaacacattcatacatttctgtgaaaatgcaagcccttccatttcattttggttagtaataatcatatattttggccaggcttccctcccccaatttcctacggctctgcacttgacattcaccaaaaccctgttagtttcccccaaaccggacgtgattccactcctccatccttctgcccctttccgagcagcttccttcagggctcacccacacctggaattcagcaccagctattacatctgcatgtcggctcctgtgaacccgtcatcccctcctactacaggccggggccactgggccctgttagttcagggcccctccattccccagaatcttcttccactcacaacagggcaagggtttttaacatgcctccttccttccatgccttgagcttcttgcaggcaaataacaaaggcattttgtctgagtccccagagctaagcacagaacctggactatattaggcctttaatttttttccaaatgtcagctaacaggcacaggcatgcatacatacacacgaagcattttatttttttacctgatggggacacaggccagggtttgacttaggagtacataataaggattgacaatcaggacattaaagcagataactttgggttcaagttctgattttgccgcttactaggtggtgaccttgaataaattacttaaattaagattttcccactcacttgaaaatggggataataaaaatcataacaatacattttggagagtattaaatacggaaatgagctaaagttagctcatgcccggcatataatgtttgcagctagcatttagagtgcatggggctgctgatgtgttgatgcctgaagttgcgcaaatacaggtgggtagtggaatacggaaacaatgatcccataaaccaggcccaaagccccatcactgaaggaatgcttaccttagcctgaattttccagtatcctctacatgccacaggcagagccaccacccagagttgaagccatctgaaggtgacatgctgcagccttgtcctcgcaggtcattcttcagcctcctgacctctgctcagaagcctgtctgtgcttacggactgggctctgcacagctgtcacatcctatcactgcccctccaggtttgcagtcaaagaccacagcagagatgaggcataatgaaggacagacacacccaactgagcaccaagcaagcgacatatcctaatacatatgtgcgatgtgtgcatgtaagggcaggagagcaggagagaattggaggaaatagctgcaaccaaaagtgaagaaataataagacacctggaaagaggcctctctcttctgatctgtgaggccgtagtgcagtggaagcgcctgatctagagagaggcaggcggatatttgtccaaactgcagctcacacctgtaaccccgtttccctcctcaagtcgtctacatttactttgcctcagtttcttataagaagatagaggcagtaacatctatttttgtgtgtttttgtgaaaatgacatattatagagaaagagtctgttaaaaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcagtgccacctgcgcagtggtgtgttgcatccaggaacaatgtccacatgatcagtgtcaggcacagagtggcatgggcatcctcaccattctgtctccagtcccatccgtggacaaaatgccccctggaaagttgaacagagattgcttcaaatgggccaaatatgcattagtgaggaactaaactgctttgacagctcctgtgtctcctggatgggaagtggggagggagtcatggagttttaatctcatcctctttgtggcactgggcacgccactcaagatccctgcttatttccagcttatagcatagaatgagaagccattcacccttgtgtagagtgatgctgggaagaattaattattcaatgacttaagggtgcttctgatatcaaaagagcccattatcatcatcggcctcctctccccagtgtgaacacacggcaaacctgagactcattggaagggacgctgctcagacctgcgagccccatttccatgggtaggtgaaatgtctcatggctgccgacacccttgcggcaggtcctgggcgtggttaagtagggggaaagtgtatttcttttctgtggcaagatttattctgtaggagagctcatactttggaagcagcaataacctaggactgctcttaactagcttgatgaccttgtgtgtgtgtgtgtctgtacgtgtgtgagtatgtgtacctgcatgtgtttataccgtatatatggatatatgtgtactccggaactcataatatatacagttataaccattgttcaatcataagctgaatatgcatgagtcactctttcctgcactgaactccattttgtctgtcacaggcgttagatgacagcttagatcatagcctgctccaatctttacattttaataagcaccttttttcaatgccactctgatacaccctctggtccttcattagtcattgctgatattatttctctctaagtgcttcttcctccattttaaagaacaacttcgatgtggttttttttttctgttttttaaattaaactttgtattttgagataattgcagattcacatgcacttacaggaaataatacagagagagcccttgtaccctttccccagtttcctccagtggtaacacccaggacattgacatggatgtagtcatgatacaggacatttctgtcctcacaggacccctcctgttgtctttatgaccactccctccaagccctacccatccagaaccctgacaaccactgatccattctcatttctataatcttgtcatttcatgtagttaaataaatggagccataggtgtgtgaccttttgggattggcttttttcctcttggcatatttctctggggatcatgtatatacactgatatggtttcaatcttggaggaatcctgattctgaaatcctagagtccaaatctgatgatttcagggctgaacagttcccttctttgagtgatgaggacctgaaggctgagagacctgaggtgtcatgcccagggatcacccatggcacagcctgagctcacagcagagatccggcctccaggcccggagcactcctccgccatgaggtcttttacagctcagactgggcaaagctctttttaattccaccaaacctagaattgttaaaaaaaaaaaaaaattaattaattaattaactaaaaacgctcaagatgccctcttactgccagccacaaaggggattctcagccatcccagcctttgtgggcactggagcagccgtggcctctcttggtcctgcctgtgtgtgcaggagcaggcacaagtgggctcaggctgatgcccccagaccaccctcggcctctgacccttgcctgaggctggcctccacaccatgatgccatccaaggaaaggcatctccttaatgcctctgagagttccatttgtaaacatttttgaatgaaggtctctaaagaagcagccaaagggcaggatgtcccacaacacaaaataagacatcctccttatgctgtctctgaccaaagtcctcatgctcacacagctggcccttccctctcttctcttcttctcttccttcccctcaaagaatatcccagcctctatcaaccagcaccgtggctctcatcaagatctttgccggtcctcggcccttgttctccgaacctctgtgctctcttacataaattagcaacctcctctggcatctctaagcctgtgcaccacccattccccttgtcccatagcacaggcagcacagaggcatggcatgccagagaaagcaaagaagggagaagccttaaattcctgtccttgaatatgctcttgccccagacatattgctcatcgggggtcataacagctcgcaaagcaaccttttcacgtacctgagaaactctcccaacgtgtccaagcccgtatagctgagtcacttgacctttcttcactatgacctcacctacctgggccctcaccaatccatccagataattgtaagattgtataaagttgaccgctttctcaatgcattctcttttctcatcaagatatcagaaatctttgacatgccctagaaaaaaatgcatgtgatacggggttttactgtagagcgatggaaatgttttggaactggatggaagtggtggctgcacaatgctgggaatgtactaaatagatgacatggaattgttcactttgaaatggttaatgctgtgtgatgtgaatttcacctgcatacattatttttaaatgcgtatggggtcacttccaaggtgaagtgcccagtcttctttcagacatgaggtgtagctagagcattcatgaaggtatgcaaggaagggctgagatgagcagcaaggggtggaaaggaaagggtaccgaagtgctgctgtgctccacgctggccccttacatagctggagacacaaaagtggggcctttgcgtatccagattcgaagaatttgatgagggcattatcaagatgaaaatgtggaatattgttgttggcaaagccacattaacacacccacatagcacacatataaaagttctaatgactgtctggtgctttaaaatccagggcttaatacaagcaactcaagttaaccaatttaactgtgaaaacccaatcataggcatttcctgacattttgaatttgcaattgtaatgccgttggtgtccatgtagtaaaaaagtgcaatatttggaggatgcgtattttacttttagattttatatatttatcaattggcatgatcttaaaaaaaatctagcattaacaccaaacatatacaagtgttgtatttaatgtctgtgcacctaaatcagaccagtcagaccacttcacctgttgggctctccaaagcttttcagaaacacagcttatcattcacggacacctctgaagaccagaggcattgtctgctgaggctgcatagttgcttagggcctgaaaactttgtatggtagtttgtaatttgcaatgaatcagttacagccagaattaagatgattttcactctaactacaaaacaagtttgactgtaaacaaacctagagcaatatacagagtatatctggaagagatcttccaatacatactatctttttataaatgaagaagcagaacccagagaatctttttttggaaagggaatttgaagaagaaataatttttttaacgtagccggatgcgatggcgcaggcctgtaatcccagctactcgagaggctgaggcaggagaatcacttgaacctgggaggcagaggttgcagtgggccacgatcatgccactgcactccagcctgggcaacagagtgagactgcctcaaaaaaaaaaaaaaatttaagaatatgtgtattcccgttttttacatgtaattgggtatttctaattacatatcacttgttttttattcctgtgatatgataaagaaaacaggcattggttactggttccttgttatttaataaaagaaagaaaaataaacaacctctataagtgttaactaacttggcaaagcaagccttgatttccggcagtcacttagggaagaaagaggccctggaactctggaccccataatatcaaaaactttcactactggaatgcctcatagcatttacagagatccagaaatggaggctgcaaaaattatgactaggtaagagttggctagagacaaggaagcatttccttggccaaaaatagagctgaactctccttgctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcccaacagaataaatattaagtaagcgctatgtacttacataatttgcagaattgatcggctgacttaaaagcttgaatccccaacaaaagaaaatggagtgctttgtgcaaatgttaaatgcacagtttaattggcaattgtgtgttggaaagctattgtaaaaggatcacagttttgaggtgatgctccagatagcacagtcagggaaataagttttcatctttggcattaaaaaatcaggtcttggaattgaagtaaaaaaaaaaaaatagggcagcctcagtctggatctctgtctcatcagaatataactttcttcctcctacactctgcctcctaaatcagaatttagaacatattaaatatgtaggctttaaagattctttccttgcctaaataatttatacacgtctactaaactgttaaatatcaaagaaacacatgcacatggacacacacactcagagcattttacaacagtgatttccacctcccaaaaatttaagaacgtgctcagcaggaagttagagttgtcaggtcccctccagtggaaacttaaagaaatgtgttgtattttgtttcaatgaggatctggatggagagttcgccatcttgattcacgtaacaaaaataggtgagagatacatgtgatccccgaggagaactattagacttcccttagatgcaaaggttgtctcagtcgtgaaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagttaaaaaaaaaaaacaaaaaacctttcttcagctgcgactgaaaaagatccagtgataccaagcgtacctagtttccatcctcataaaataatctcttaagtgtaaagaagcccagtgcaaaccaccatgaattatcatcatcgtttcctacagtgagttcggaaattgctttttgcttctggatactgtgaaaagccaggtcaggaatccacaatgggcatcagtcatcattgtgttgctaatacttgccatcggttcaagaataggaatattaagattgcatttcttcattcttccttgccaaagggaggaacaagacagtcaaagggcatggacccctggcccttgattgaaaacactaacagatatgcatgcagttagaccccagtgttcatgtgtccaaggcaataggacttccaggagagacatccaagtgaggaagctgcaagtgctgcctggaaacacctctatcttcaaactccaccctctctggcttggttgggaaaacctcattactctcaattttctaccaaatgatggtgaagaggagtcatttgttggaagaaagggattcattacagggaaacaggtcttgaaaaggatcaataccatggctgcctccttgtccagccaaggggaacctgtgtggctctcccaagcctgctctccttcaggccctcagaagttcatgctgtcattaggacagtcctgcagtcaatggcagggggcgtgatgtcccgaggtgtgtgaggtcttccctgagcaaacctgtcctttccagtgacctgccacggtgcccaaaattctctcatccaacactgtgttagtgagttgcttgaactctggggccaggctgcagaattgagtgccagcttttcttcttactaactggataacttctggcaaaatttaaaatagcagtaattgcagtatctacctgataatggtgttggaaggattctatgattaatacctaggaaaaacttgtgagtgtctggtgcattctactatgcaataacattagttatttttattatttaacctcagtgtgttgtctggcaaatagaagacacagtcagcaaaacacagaaattcgttaatgaagtgaccgccaggcacctggacgagccctgagggtataggcaaagacatgctggtagaggaaggggtaagagagacctgaaaattgaggtctgtccagggaggccgggctggagacaccctgagttcctagaaagagcaagttatctatgagggagaagagaaccattatagtggtaattgtgcaaaaaggaaaaaaaaagacaaaagaaaaaggcagccgtaatcgttagatgccagggacagtgctaaccactttatttatatcatccaatttgatcctaaagcaatcttataagctgggtatattctcatttcatagaaaaagaaacaggcctggagtgccctctcagttagtcgatagtggagctgggagctaaactgttgcccaaactggatccatccagctggcacaggtcataggaaccccggggtctcagcacttcccagatgcctctgttagtgcttcctcttacttggacccagttgtcttaggaaagcaagacagcagagaagcccagctcctttctctcttcctggtacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaaggacaaagagttcccaatgtaatgtggatacaaaagaatccaaccactcagcttcatcagtgcccttggcaatgcacgtccaagaagcctcgcacacagagctgggaggccatctgaggtctgaccactgtgcctgccagaagatgagcattctgtttgtctctacagttgtgtgtgccctgtggcactttcacatattaagatttgaaccccaccaccccccaaccctgtgactgatccccacagcctcccctttagcctgggtgaattaattgaaatcataggagcagtcttagctgtgcccgtcatgcggtcccttgagacaaatgcattcggtagatgatacatgacagcctgaacacaggccagggaggagaccctggaaaagcagggacagaaggaagacaacttcccagccagcggccttcgcttcaagacagaatccactctcctccctgctcaccagtaacatgagggctgagcaaatgggaagatggtctttgagagttatcgacttcctccttttccagcaacgacatcatgcctctaagtagcagttcttaggaaacatgaagcccccaaggacagctggctggaaactttcaaagctttgcaggcataaccactaatgaggagcaaagtcgctgtttatttgagatggtgacagacactatcagcacacttcacacagttcagatatgtgtttaggttcagaatgatggggatttcaagaccaaaggctctcgaaaatttcagcaacccaatttattcaccaaagcattaagccaggatctattttacatcagattgtttgaaatagtgatgtaagaaatgtgctcttgatgtggagcctccagaaaaggacttgatgtgctcatgggttctcatgacctctgaggtctttgctgcagagaattcaccagcctagtgcctggcacatcacaggtgctgtgttaactgaaagaatgatgaattattaaataaacagccactgtgatgtggagaggaaagagttgggcacacttgggttcaaagagcaccacctccaaacgccaccttgcctgcctacttctgatggacactgttagcaaattgcttaaacactccaagtttgtgtttccttatcagtaaactagggataaaaatatgtatcttcactgggcatggtggctcacacctgtaattccaacactttgggaggctgaggtgggtggattgcttgagcctaagagttcgagaccaggctgggaaacatagtgagacccgtctttaccaaaagtagaaagaaattagccaggtgtgggggtgtgtgcctatagtcctagctagttaggaggctcaggtgggaggatggcttgagtccagaaagtcaaggatgctgtgagtcatgactgtgctgctgcactgtagcctgggtgacacagtgggatccagtctcaaaacaaaatatgtgtcttgcagtgttgttgtaagccttgatgcactctttcctagtgtaccgaagcagcctaataaatgttagccccccggttgcctttccacttaaagagagatggggtgtattagcccattttcacagtgctataaaggtactacctgagactgggtaatttatgaagaaaacaggtttaattcactcacagttctacatggctggggaggtctcaggaaagttacagtgatggcggaaggtggaaggcaaaggggaagcgaggcatgttttacatggcagcaggagacaaagcatgcaggggaaactgacattttgaagccatcagattgcatgagaactttctatcatgagaacagcatatgggaaacctcccccgtaatacagtcacctcccaccaggtcccctcctccacaggtggggattacaattcaagatgagatttgggtggggacacagagccaaaccatatcatgaggaggttatatcaagtggatttatagaactgagaaacagttgagaggctctgtggtgtgcggatggttttggaggttaaacaaaacaaagaatactaataccagagttccttccttgaagccagttaagatcgtcacactcaaagggaagagatagactttatcttgtctctcccagtagattgataatggcaggaggagaaagggcctttcctatcctttctatgcaaaagtgtggtgtctggaacagcatctgggtgtcaccagacagtcttttggaaatgcagcatctcagcttccacctaagtaggctggcccagaatcaacatgatgaggagatccccaaatagtttacttgcactttgaaaagaaacactggcctagagcaccttcccctctctgggtcgccaggttctttgatttattaagtctctgcagctgactgatatggagggcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacagtgacccttacttgaggatgcataatcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgtttttttttttttttttcaaattataaacctcatatatatgttaaagcttaaattcaatctgatgtagagatttaactgtggaagtgaaacctctctaaaaaaaaaaaagatcctaggaaacaactagaaatatgagatttattctaatcctaattgcatgttccatatttagacacccttcccacaaaaggtgagagaaatgcttaccttgtccaattttacgcacaagcctccactttaaggaaacagattactttttttttttaaagaactctcaaattacccattgataaatacagcactcaaatttttttttggaaaaggcacaaaggtaaacagataaaggagttgagtggtcacctcatgacaaggacagtttgagggtttactcttgttttcatgggagcattggtgcgggttacttcatctgaaagaaactttgagctctgaagctatgtctagcacatgttaagtaagagtggtccttggaaatttcaagcgttggtttgcatggaagcacaaatcatttgacccacatgaaaagaatgaaatgggatggaacagaaactcaaatttaaagtattaagtgcttttgtcaactgcaaataacatgtctctgggatgttagtgtgtaaattgggcagtaagattccatgtgtattagaaataaacttaattatttaggaggtagggtggacctcttcttacaaaattatattttctaaaagaaaataaaagcctatgagctatcaacagacatattgttgtaacaacataaaaagtacatctttagccagctttcactcatccaggctagtgcaaataaggtgtctattaagaaatggacaggtcatgctcaaaccttccacgaggctgtggtcccatctcatccctttctcactctgacaggggcacagtgaacttcctagtccattccatgtcctgcccagctcagggtggaggagccaaagagccctgctgtgaccacccaggagggagagagggaagggcttggttcctccacgctgcccaagcctggtctgtctcagagggcagggctgaggaccagagcgcctgtgggccagatctggagcagctggcgggagtgaatgacctgtgattctgcgtcctccctctactgtggtttcctgtctctgaaaccttatttctctcagcatcctgactataattaacatatgaaaaaaagaagccaaataaatcaagagaggctgaagcccttcgcatttaaaatccatccaccatcgtttcccccattttatcagctgtgcatgtgctgagatggattatgcattgacactgtctttgaatagagggtgagttgggatcctggtaaagcagccattagaccattaaaggcagtaggagagatgcaggaagtgccaggatcactagaatctggggtccctaatccacacaacctcacccagccttacaacaagtcctgtcaccctgaactgcccaggcttacagagtaccttcaaagatgtgaaggggcagcttatctttcaaggtaaccaaaatatcatcttgatattaaatcagattacttggctaattcatcagtttccctcagagttaggtaccctgcacatgtcgttgtcacctttagatggcctcatgcatgggaatgtgaattattcataggctttctttgggttgcaggaaaccttcatattgctttagtttcttaatgtatttgataggctctttgtgtatgatcacattatatgggtattgctggcagtacagtaaattttaaattatatagtctgcagctttgcactaagacatggtaggagatgattcatcattttccttgtcttcctgtttacatgcggacatataattcatgctcagaaactatctttcagctcatctggaagtgctccactgcaccaccacagaatctatctctgccagtccagaattgtaaatcacttttctattaaacagcggggctaaaaatgcaaacatatgtactttaaatatatgtagccatctccaattcccagaagatgagccaaaattaaaggatagtcaaaaaagctagtgctagaatttaatgaatgaatgatttgacttgagatcagaaatttgcatttctgtacacatattgaagatatatatacacacacaggtttcccagaatgggcctgtctttgggaactgtgtattctgcagattttgtacactgaatctctatcattctgaaattttacttcctaagattattcactcatgcagagtcacaagacagacttgatggtggggagaaaaggtctgtataaattctcagtttagcatgatatgaagcccttgtctgccatcctcttgaccttcatccccaggccaagacaatgaagtcatttgctcaggatgatggacatctagactcagtagtgagtgcttttcatctccaaggataagattccacccagcaaatctgcctactcaggcagtagtgggagttagatatttcagaaaggttttcagcagtcactgtttctttgcccaacaatacacatcatcatggttctctactccctgaacctgattcagctgtgatagtggataaccattttcacacacatgctcatgaacatctggcattgttgaagaaggaagacctttccgggtaactgaagcttacccattgaagagttttttgtttaatattgcagctgtcttaatggaatccttctgaactgtattatttgcttgcctactttttttttttctttgagacggagtctcccactatcgttctgttgcccaggctggtgtgcagtggcatgatcttggctcctgcaacctccacctcctgggttcaagtgattctcctgcctcagcctcccaagtagctgggattacaggtgcctgccaccacacctggctaattttttgtgtttttagtagagacatggtttcaccatgttggccaggctggtctcgaactcctgacctcaagtgatctgcctgcctcggcctcccaaagtgctgggattgcagttgtgagccactgtgctcagcctgcttgcctactttattaagcaaaggctgccaaaccatttcatttgtgattctgtgattctgccgagaattgtggtggctgtctgtccctgtagaccattggttgccttgccttggagctcacagcctttcacctgtgctttatattcttgtacatttcaagaactagagttccaaaatccggtttgctagacttgtgctatggtttaaatgtatgttctccctcaaaatgcctatgttggcacttaaaccctaatgtgatagtatcaagagatgggtcctttgcggaagtaattaagtcctgagggctctgccatccttaatgggattaagccccttataaaaggggcttcagagagctgcctggccctttctgctcttccattccttctgtcatgtgaggacacagtaagaaaacaccttagctaatgaacataggaacataaaaccaaacacctcacttataagtgggagataagtgatgtgaactcaggacacaaaaaaagatacaatagaccctgagacctagctaactggggaaggtgggaggagagagaggagcagagaaagcaactattgggcattagacttagtacctgggtgatgaaataatctgcaccacaacctccctgtgacatggatgtacctttataacaaacctgcccatgtgccccgagcctaaattaaaagttaaataaataaaataaaatgccactgggaagcagaaagcagccctcaccagatgccacatctcgtaagacatggagactgttggcacctggatcttggaattccagcctccagaactgtgaaaaaatacattcctgttttttctaaagtacccagtttcaggtatgttgttatagcagcatgaatggactaagacaactcatatgataagctgggctgccaagtcctgcagaaatacctgtgtcctcttcctgcacagtacaggtcagggctttcacgaacaagttttgctgtggctcttctggagttccaggggcccttctgtgagtgggttttggggggctgctttcttccttatttcatggtagtcttgaattagtgataaacagagtttgaccatatgtgtggataacatgtacaggtcttgattgaaactcaagtttgaagagcgtttgctgggtgccaggcataaaaacggggttcctgcttgtattaggcctcaccctcgttatttaattacccactaaaggcctcttaacaaagtcactctggccattaggtttccttttattgttattgttttaagacagagtctcgttctatcacccaggctggagtgcagtggtacgacctcggctcactgcaacttccaccccccgggttcaagcaattctcctgcctcagcctcccaagtagatggaactataggtgcctgccaccatgcccagctaatttttgtatttttattagaggtggggtttcaccatgttggccaggctggtctcaaactcctgacctcaaatgatccacccacttcggcctcccaaagtgctgggattacaggcatgagccactgcacccagcctaccactgtgctcgaccctcattaggtttcaatatatgaatctggggggcatcagaccctagcacagcttctcacatagcccctctcctccccacccagcctctcttcttcctttattacttctgttaagtgcagcctattcattggttgaccttttcagtcctataactcagtggcttagttttttaacaataaatcacaggaaggtggcttaactattgaaaattttattaaaatggttataataatgacttcattactctctgaggcttccagatcttctcttcattccagggaagctggctatgtgaaggcatctgagaattgctattaacctctgctgaattaaaaacaggagcggatgaacaatgttggaagtgggccgagggcttttcagagataatagttgtatgatagcacccccagtttaaatataacacttttgcattataaaaaaggcatattaattcatggtaaattgaaaatttaatttaattttctctagatgagtgaggaaaaaaaaaatgaagactccttactctgcttgattcagttaccatggggatagaacatcttttcgggagaacctctgtgacatggcacatgagccctcaccttctgcttcacatgcctggttttgtcgcccacttgctcttcctgatgaatctgccccagcatccaaatagcacaaacccatgaatattctgtaacccattttcatctttgagcctttgctcctaatctgttacctttgacccctatcctcccagccacccaaattgagcatatcttccaatgcacaactcaagtcccaccgcctctgtgctttctctaactccacagccacacacagcctgtcctctggccttcctcaggtcctaacagttgaggtgggcataaaagaaatgagcagatgaaaataatctgctttgtagccaggcgcagtggctcacgcctgtaatcccagcactttgggaggccgaggtgggcggatcacctgaggtcaggagttcgagactagcctgaccaacatggagaaaccccatctctactaaaaatacaaaattagccgggcgtggtggcgcacgcctgtaatcccagctactcaggaggctgaggcaggagaatcaattgaacccgggaggtggaggttgcagtgagccgagatcacaccattgtactccagcctgggcaacaagagtgaaactctgtctcaaaaataaataaaataaaataaaataaattaaataatctgctttgcaacagacagaactctttcagtaaaatatccagatccggaagctcatttcctgcatattttgtctgcctgatgagcccctcctcatgtacctgcatctctttggtgatcagtcttcaaggcatggggtggaaccaccagtgctcagtctggaactccaatggtgtgattggcaggagcagagatgccacagcctttcaggtcatgggaaggctttttggtggttgttggtgttcttcatgtaggaccctgacaccccttccgtaaatgtaattattgttaaaatgataatccttgagataatggaaagcaacccagtgaggctgtggaacctgcattgaaaattgttgaggtagaacagactgctacaggtgagagagtcttggtttccactcctgtcggcatttggcatttttgcatgtacaaagtctgttccccatcccatgacaaaccccaggtgaatcactggacataaagatggtatggccaaggagaagcaaaacattgcagaccgtctctaccagcagaagctcagcaccagggtgcaactcagatgacagattgtaggtaaacacgtgtgcttactacccattcattcattattcattcatccattaacacgttttgcaaatattctttaagcatccattgagtgctaggcaccagggatttgatgatgggcaaatatagaactaatgatacccagtcagagagagagataagaatcaagtgtaactacataagcaaatgtaaaaatgtaatggggacacactctctgaaacctaggagttggtgggagatgctggtaacagcctctgatagtggggtgtaagccagcaagatcagccaagccccctgaggctctgagatcaaattgaaatccgaaggatgagtagaagatgaagaatggtgaaaagaatgttagaatattctaggcagaaacatgtggccaagtcctgttgggcgggggcagatgagaggaaggaagaggtgggagatgtccctagtcctgcagggcgtggtgtgccacatcttcctagaagcaacgggaacccatggagaggctcttggggtgagggtagagtgaggacaacttcacatttgcacacagggaaaatcctcttctcttcagagtggagaataggcaggaggggagtgagcatggaggtgaatagaacactcagaggccactgtggcccagccggggaaacatgacctgaccattccctgggaagacactgtggcccaggaggacacacacactgtcactgggaggacactgtggcccagacagggacacacagcctgactgttcctaggagaacactgtggcccaggaggagacacacagcctgactatccctgggaggacactgcagcccaggaggggacacacagcctgatcattccctgggaggacactgtggcccaggcagagacacaggcagcctgaaccatgatggtgatggttgagtggagagaaatggacaacgttaagagatactatgatgtaaaatccatgtgtgagccaggagaatagcttcaacttggaggcggacattgcagtgagctgagattgcgccactgcactccagcctgggtgacagagtgagactctgtctcaaaaatataaaaaaatcaaataatacaataaaataaaatccatgtggcaaggtgacccactgattttgggttgttaggaaaagagaggtatcaaggatgactgctaagttctgtgctctggataaaaatgaaactcaactttgaggaaactgtgtactctaaatgtttctgcattggtctcccaggccattccaatcaactgcaaagcttcatctttcataaaacatgaccttaaatgaagacttaactatattctaaagtttgctgtgtacattaaataccatatgtggtgaacatttccaaattccttaactgtgtgacacttcatttgtttttggtttcaaaatggaaatcacaactgtccccaatgtatagagttagattttaaaatttaccaatactaggcaattgcacaaaagatttctagtaatgtccacaggaaattaacatcagcaacacaatttgatgacgtaagagggcttttgcaacatatgatcagttccttcattgttaacattttaaaaacattctgatatcagggctgggcatggtggcttatgcctgtaatcccagcactttgggaggcagaggcgggcagattacttgaggccaggagtttgagaccaacctggccaacatggtgaaccccgtctctactgaaaatacaaaaattagccaggcatggtggcacatacctatgatttcagctacgcaggaggctgaggcaggagaattgcttgaacctgggaggtgaaggttgcagtgagccgagactgtgccactgcactccagcctgggtgacagagtgagactctgtctcaaaataaataaataagtaaataaaaataaataaataaaaacatactgatttcagagtaagcatatcatacacaagaaattacctttatacctcgaatcccttttgatttttagaaaaataagctcagaaaatatgcacttttcttagaatagtctgcaaaaatttaagaagataagagttttctttcagaagacattatacagcctatatattttaaaatagaatatatatctatagaacaggtacatgattttgagcaaatcatgttacctctcttgaccttgccttctttcacaatggatactccaattacgtgttatccaggttcgttttggcttttacgattgtttaattctactttttcaatcccacttcctttacccagtaataatattcattggtgtttttcccttaatcgaagaaaaaaaatgagaaaaaaaaatctcattggtttgggagtctactctgtgacaggctttgagcatgtgtatatatcttattagtaatctcagcacctgtaacacttgtgtagggaatgtttcattttacctattctatcgataaatagcctgatatttaaagaacagagacatttactaacttttctaaagttactggaggcaggatgtaaacatacgaatttctggcttcaaaaccaaaattcttttcctgggtcattagaatcccccatctaccaatacactagtgcccaccctctctctgtggagtcagtaatactttaacttcgtatagcaagcaatgcttcaaagcaacctcacagttttggtcccactaccccttaaaattggaaggcaattcatgttacccacttttgatgaatgagcaactgaagatgatccagcagcagccaccaagtggctgagacacaactagaaccttgtctctctattaaatgcatttcctgatgacacgatgctgaaccttgagactcacaggagattaggcccatggagaagtgggaggaagaggaacaggggaggagaaaccatggccagagttctggggctgaaggaagatgagagggaaggtggagtcctcaccaaatggcatcatgtctgcaaggtgctctttcagaaattccagtaagatccaaaagcatcttgccaatgaaactagaaaccatttgataggttcgatctggacaatttttgtcttatgccagatgtgagttgatgaatgtcaaatgatagtttcagatgtaaacagcagggttcctgaccacagcagaagagcagagaaaggaaggaacccttcagctcacagaatgtgaaaggcatcagtaaataggggagcatcagtgcccatcactgtcaagggattactccaagacacagggattcttcggggggcctttctaatgtcttaacatttaatagaattgaagtgtctttcttcgtacagtattgcaatccatgtagtatgggaactttatcaaactccagaatatgtgacagtggacatgtgatcctattaccaattttttcaggatcgactctacatgggcatcctcagtaggctctgctgtcaaaaatccataattaatgctgttttaacaagtgtcaaggcaaatgtggccatttgtagagaggaataattatttgcttatttttggtggtatgtgatcttcagagtcagagaaagatggggcttacagtcaggtgtcaattgtcagtaacgtgcccttgacttccaggaagttccttatctccttgaatctctcttttacacctagtgaatgggatgacagtttccttcaaccagtttcaaggatccagtcagataatagatggtaaagtgagccctgtgctattggtggcaatgtaaaatggtgcagctgctacagaaaactgtacagagttccgtcaaaaaatcaaaaatagattacaatatgttccaataattccacttctgggtatttctccaagagaagtgaaattatgatgtcaaagagatatctgtactcctaggtttgctgtagcactattcacaatagctgagatgtggagaccacctaaaagtccattgacagatgagtggataaagaaaatgagggacacacacacacacacccctaggaatattaatgggtgttaaaaaaagaaggaaattccgccatatgctacaacaaggatgaacctagaggacattatactaagtgaaataagccaatcacagaaagacagatatgacatgattccacttagatgagagcggaatggtggttgccagggggttgggagaagggaaagtggggagttgctcttcagtgggctgtggttataaagtttgttattgcaaaatgaataaattctaaaaatctgttgtataacattgtgaatatagttaacagtattgaacagtcactgaaaattttaagatagtagatctcatgttatctgtttatatcacaataataatattaataataacaaaagtttcaagcaccatggcagatgtatctaagaggtcttcctcctctcaccctgcccctcactctgctcctctcccctacactgttgacatcctcctggactttactcagcctgcttcacaaggacaggttcagggtgggtaagacttatttggggagattgtcattcaaaactgaaggagtactgagtgccagacactgtcatgatcagagggtggaaacccctgctatttgaatggatcatcaggcaaaatgaggaagtgtcaggaattgccctatgcctgccttttatcctatgattcagagctctcattcactaaagctacaatttatttaacctgctcagaaatttcaggaggaaaatcagtggatgagaaatcaataataatgaataatctcccattcagaaatatcattagagattatttttcattattccactggtaacagcaaatttaaaagatactgttataaactccatagcccaagcttaatagaattaataatcaaatgggatcctgagatcaataattctcaaattgttttttgtactccaggaattcccagtgtgtacttcaaagtgaatctgacacttcattttaaaaacaatttggagtgacttttgtccctatgaatgatgccaaattgatagtttaaaaattgatgggtttaacccaacaatgaagagactgcaactaatcagtccattctttccttctgcaagggtccttggctcatcaaaccatctcgaagtcctcatttaactaattttattacttgatctacaatttatttcaccccagccacaaaatagaccagtacttagggataaaagtagctgacacaaattttgtttcaaataggtcattattttatcttgatatataaatgtcaaagataccgcttgggttcaaatggtgccagaagacagacaaatgggcaggctatcagagagaaatggaaactgggaaagaatctatttctcttcattttagtaagaacctaagatattgtcctaagcttacaattgcagggacagaaggagaatctgaattagcattaaaaatgattttttaataatatatataagggaacttttaaagttcatggaaaagtggacttaaaagataaaattaaaaacattaactttatttctcagtataagctccatcaagttcaaaacactttttaaagcaatgatgtcagtcatttagtccatccctaaagaactgagggtccctggaatttagccatttcaatgtaaccttttttacattattaactgaagaaaaataggtgccctttacagattttgtaagattaggaaacaaaaagaggtcaaatggagccaaatcagtatggtaaggtgaatgcctaatgattttccattaaaactctcacaaaattgcccttgtttgatgagaggagtgagtaggagcattgtcctggtggagaagcactctgtggtgaaggtttcttgggcgttttttttctgctaaagctttggctctctcataataacacattatagttatttggccctccagaaagccaacaagcaaaatgccttgagcatcccaaaaaacttgctcttgattggtccacttttgctctgactggaccacttccacctcttggtagccattgctaaggttgtactttgtgttcaggatggtactggtaaagacatatttcctctcctattgcaattctttgaggaaatgcttcaggatcttgaccctatttgttgaaaatttccattgaaagctctgctcttgtctgcagctaatctgagtgcaagggttttggcacccattgagtggaatgtttattcaactttaatttttccaccagaagttgaagcaattgagatagctatagtgttggcttttgtttttgctgttaattattggtcctcttcacttagagcatgaacaagatgatgtttttcctcacaaattgatgtggatggattaccactgagggcttcatcttcagcatcatcttgtctcctattaaaacaagtttttttatttgtaaactcctgatttttgaggggcatttcttccataaactttttataaagcatcaattattacaccattcttccgtccaagcttcaccataaatttgatgtttgttcttgctgcaattttatcagaattcatgttgctctgatggaggcttttttttcaaactgaggtcttatcttttttaatgcatcaaactagatcctgttcagacatgttataacaaattagtacaagcttatttggtgcaaaatattttgtgaaacccatgcatagttggtttttataatacacattttttcatgaactttttgaagaacttacatataatatttcaatagtggtttatatatattttaaaatgttttagccttataaaaagattagagaaaaaatatttctggtttgggaattgaacatcataaaggaaagttagagtttgcaagatctgaactggccacctgagaagcagctacattatccacatttccttctctgcaccctcctccgcaccctcctccaacccctccctcctatcctctccccatcctcccacacagatatggatctgatggtatgcacgaagcacatggaaaattctgtggaaagacaagaggaataagctatggcccccactcttaataggaagtaggtaaagatttgctctgcaaggaatgataatcaacaaactatttctcagttcttaaaaagaagagataagctagaccttgattagatgcagagaactgtcattagagatgagtttctcttgccttctttccccctgttgctgtgacttcttcatctttaagggactgatgcagcttcatttccacgtgggtcttgtgcctttggattccagctaaaagctcctcccagctgtgaacctgggtcatagcccatgagagccacaagggacttgagtgtcttctggttcaaccacctcattttacagttgaggggctggtgaagggactttcccagtgtccccctgagttagatgtaaagattggggctagcccaaaagctgtctgagcctcagccatctgtcactcattcctggtgcttctctcacctcctcaccaaaagacaaacactgtggtttatccaaaagtggccttgcagattttctgattcatgtctttttgccactcaaaaacattgactgaatgagccctgagtgccggatactgttctaacctatagactactgtgtgaagagtagaattaaagtaaaacaaagacaattataacataaaatcagtccaaactattctacctgtaagtgcataaaatgataatatgcatttttgcatcactgtaaagaaaagtatttcatgtcaccagttccattcagagcactgtaattggcaattacttatttttgacatttgtaagacttcttgaaagatagaatttgaatgctgcatctagtgactgattcttcttgcatattgagctgtttcattattttctactctgctttaaacttgaatcagtatagaaccctcccacattcttgacagggtcctctttactcaagatcttgggatcacaggtttgatctggatcaccctgtctcgtatcttggaaatgatgtctttgacatggatagagatggctagcatgactttgatttgttgtctgtgcctttccttgtggcatgagaggaggctgagaaatactgggctattgtgaatgggaaatgagagttcttacaggcacgctgagcatcccagttttgggcattcagtccaagttttgtgtgaggacatcaggagcctccctaggaatacgagtacttccttcagtgcatcaggcagtatgattagaaccacgatgtaagtgtcaggataacatcgggcatgagagtctgttgctgggtctaatagcataaaacaggaggtggtcacagcaagtataagcactgggaggtgtcggcatggaataataatactggtgcaaggagtgggcttaacatcataactgggaacccagaagccagcaaaatgcaaatcagacaggcaggcagcttctgtctcccttctgtgtctctatgcctgcagtgaagactacctgttgtctctctcctggagcacttgcgagccacagatgagagaggacctttcagtgactgattacagcctaaaggctccaggaaacagccaccactgcgggcttcccccacgtgcttctctgaaaggttgtcagcagtgtattgatgattttcaagtatttgagcatacttgtagcccttgaggtcaaccggcttccttggagatggccattctactctaccagccagggaggaactgtccatggtgctgcttcgcatccagaggctacagggttgccgtgtgataggagccacctgggcagggacttaccctcaaacagcctcgtgtttcatggtgcagcactacagggacaaatgcttacctttgggccagtggagagcaatagcaatcaggacttgggagggaacctaagaggataggacaagctgatagggtgagtggggtgaggtgagatgacaaaggggcaggtactgaacaaaatcaggctatctaacaggcaggcatgctctttaatgggtagggtactatccagtcaagtgtaggccaagaaacagcaatcaagattccttggcccagaaacagggtgtcccagcaaacacaagagcccagaaacagggactctgcaggtaggcacatttggaagctcagggaggcagacttctcctctggagtgatcatctactgatagcaaaatcctagtcaccagggagggctttggtgtcaggacctcaatccctggaaagtagataagtaccatcagaacaagaaactctgtctggattggaatggtgttaagggcatcttgatatgttattcctgcttaagtgactcttaccttccatgaggttggttgtgaatcctagaggctgtgtatggagaaccaatggccctgttagaaagggtggacactgggcagctcatcccacattcagaccctttgcagcaggtctccatgttagcatgttctattttgacaaagccttttgtcctgccaggcatttaatggacttcacacattctacctgcggagctcacatcagggtatctatatctgttcctctagctatatttgtgtttgtatcttgatgctgccaagcatagggaaggcagggagaagccaaaagtcagcagaaaacagctgagataaatgacatacaatgcgggaggaacgcagatggaaatagatggcatgggagtttgaagaagcaaggagccacgaagtgctaaagtctgcaaggaggttctcaagctcatctcactatttatatcacagattacagatttcctgctcgtgtcaaaaataagtcattgccagttgctgtgttttgaagaaagaatcatgcttaaaattatttcacttagaagctcacaaatgaaactgttgactctaaggaataaactgtgtagatagtaagtcttaccagctgtgaattagagtagtttgtgagagtcgaattcagacattttcttttttgagaaaagctggaatagaaagggaagcacttctgccaaggttaacagtaggatgtctttataaattcgatgtagctgtgagggaagggacttctgcaagctttcgtgcatttgctcattcaataataatctgttcatcagtgcagtgacacaaaatatttacagaacacagcatcagtggctaaggagcttataagcaaatgaaatgttaggtgtgttatgtgtgggttaaatggtgcccacccgaaattcatatgttgaagtcctaacccccggtgactgtatttgactaggggtctttaccaaggtaatcaagttaaaatgaggtcattagggtgggtccaatctaatatgactggtgtccttatgaaaagaggaaatttggacacagacacccacagggagaatgccatgtgagatggaggcagagatcatggtgctgttccgacaagccaaggggcaccagagattaccagcaaacccaccaaaaacttggagaagggcataggacagattctcttacacagcctcagaagaaaccaaccctgatgacaccttgatctcagacgtcttgtctccagaaccatgagatgataacttttctgttgtttaagccacctgatctgtaggactttgttacagcagccctagtaaacaaatactttagaaaaagtaaaaagagaagcgaagcaaaacttgcatgcacaacaggtatgatgatgctcatgactacagacagtgagaaaggctgtgggttggattactctggctcagcctcatagaaaaattgaggtgaatgtttaattgagtgtggggttggtctgaagagaaagaatagaaaaggagaatcatatttcatacccttactattcagtcagctatggaaagcatatttggggtggctagaagatgccaagtacagtgctaggtgatgaagcagtgaattaagttaggacaatgtggcccatgtagcctctcaacaggaaggcaggttcagatagaggaaacagcaggaaaaaggtgacaacttgaaaatgagtctcttcctcattcaggtagctttggtgctttgcccactggttgtataagagaatcctgggaaacagcctatgagtagtatttgatatcttgggatgtgggaggtaatcagatttcagtgatgataagacactcccatctctgagctgggtgtttcccagaaaattccaaggacaactggcctttaacatctctctctatggttaacttgctaaacattatccagaaatagccagcaccaacatctccttcaggaccccaacagccaggcattttctccgtagactttgctccaagcctcttatttctgggtttggatcctacctttggacttgaggggcttagatattatcacttaggtggacaaaccatccagttaaacacacacacccacacatacccaacacacacacagacacacacatacacagaatcaacactcaacacgcaaacacccaacacacacatgcacacacactttctgaagatgagttttctcatttatgaaatgagctcatctggacttgccatgagggtccaacaggtgccatgcaatcaggtgtgcactcagtatgggctgggtggagatggccatctcctttcccgtccaggcctggttcctgtgtgctgggcctctgctcttcccacctcacacagcccctgcatggaacagagccggccctgggaggcctgggatccccgtgcctcccttcagcccctcttccaaaatcttgataccggacacacaaaggacacagcagatggccattgtatgatgggttttgttctgttttgttttggtgacagctttattgagatgtagtttttaccatacaatttacccatttaaagcatacaattaaacgttgtttagcctatgcacagaattgtgtaatcatcaccacaatcgattttaggacatttttatcacccccgaaggaaactgtgccccttagcagtcactctgcatcctctgtccccaacccctggcacccaggcatctgtgatcactctgtggatgcacctgttctggtcagctcatccacatggtatcatatcgtgtgtgttttcttcatctgacttcttccctgagcgtcatgttttcaaggctcatccaggtggtagcctgtgacagtgcttcatgcctttctattgtcaaataacgacacagtgttttacaacccctttccacataggttagtatcaccagtgtgcttggatgaattgcagtttgcccagtttgctgttccaaaagctagagaattcctttttttcttttttcctcttactatacaaaccaactctaagtgataattaaaagcgtgagctttgaatttaatcagcactttgttcctttctattgtcaaataactacacagtgttttaaagcccctttccacataggttagtatcaccagtgtgcttggatggattgcgatttgcccagtttgctgttccaaaagctagaatccctgtttttctttttttccccttactgcacaaaccaactcgaagtgataattaaaagtgtgagctttgaatttaatctgcctagattcaaaatttgccatgccatttcttaggtgtattacctgggcaactactaacaccttgttacctcagttttcttatctttattttatttatttatttattttgagacaaagtctcaccctgttgcccaggctggagtgcggtggtgcaatcttggctcactacagcctctgtctcccgggtttaagagattctcttgcctcagtctcccagctatctgggattatgtgcgtgcgccactactcccggctaatttttgtatttgtaataaagatggggtttcaccatgttggccaggctggtctggaattcctgacgtcaggtgatctgcctgccttggcctcccaaagtgctgggattacagatgtgagccactgtgtccagccagttttattatctttaaaatgagattaataataataccaaacctaataggaatgttgttaaatttaataatttggtaagccattaaatcacatgaaactatacctggtacattttaaacacccttaaaagctaaatattatatatcatattctgctttttaatataaataggtcacacaatatatcagcatgcctatagaggcatttcatccttaatgttacttaacacttcaatttattacgaacctaaatggccagaaagctcaggtaaacaatttcccctataattttacgcaacaaaaattgggatttataccaatgatctcaaagtagtttaaattcttaggataatttcttagcccctgatgaaagattctcttcattcttttgaatgatcagtgtaattgtacttctagggaagatatagccgtttatttctcactaaaccatgacctgtgcatgggtgaggcagcccacagtgagcctgaatgtttggccaatccattccttatgtggactcatggaaagcctcagcctataatcagatttaaagaaatctgtagccatatgtgtttccctgacgtcggtattgctgggccatattaaattgctttacatccctaataactttgctttctattgttctctattctgctgcacttacacaaaagctccatggcagagaaattggaaagaccagtaaaaaaataaggaaacaggatattgtgtgtcctggagggtttccccggtgctccccagcctccattgcacaacctccctccacacagccccgccccatcacaatttccaacccctttactcaccccctgtgtctcatccactttcctctctgtcaaaacccacacttagacattctcagagtccttcccattgaggtccaaacaactagtgatggtttaaaatcttacgactgggcgtgagggaaggcccataccttgagataaagctaatttgaagctgatggcaggatttccaacagcagccagaggaggggcagagtttaggggcagtgttttgtcctatagtccttaaacctgccttggatgtggctggttctgacatcttgaataatcccttagtatcttgtttacaggtgatgacacaaacaagttatctggaaataaaatgaagggggaatgaaccaaaccactttaaggtagctacttttaacagttttagggggtcagttcaaaagtctttataactaaattctgaaatacagagtgccctgttttcaccttcaggggtctgacacccagtgttaggtttacagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagccactgccacggggctaggaagtagcagagctgggatttgaactcaagcacactggttccagagtccacgctgtgaatcattatactctgtctttatttgcacctacatgggaatggattctcttattattatgctatagataccttcaatatttctttctacatttaaaactattctctcttgatcctcatgaaaattatttgagatacacaggacaaatactactatcccagttttacaagttaaaaacccaaggcccagagacattaaacgattttcctcaatgccatattggaagttaacaacagatcgggcttcaaatataaatcacctcactcaaatacatgtatctctttgatttgagcaacacaaaattattaccattattgtcattattgaaagaaacagttgatccatttgaaagataagctacactgtttgtgcttctgggtggctgggatggtaaaggaaatgcatgtggaggcgtagccagcattttgctagcaagctccacaagaatgttttacctaagttcttaggggaaggggaaaatggtcagggccaattctttcatggtaccgagcttcagacactttctgtccaccatttgtactccctctgatttcccgtatggaattgaggtcttgcattttcaagaaaaatggcaaaacaactccaaaaacatgtctttctagtgtcgtagctcttagtagcttccttatacagttgacccttgaacaacacgggtttgaacggagcagttccacttatatgtggattttcttctgcctctgccacccctgaaacagcaagaccagcccttcctcttcctcctcctcatcctactcaacatgaagatgaggaggataaagatctttatggtgacccacttccacttaatgaataatattttctcttccttaggattttttaataacatttctttcctctagcagtcactttattgtaagatcactttattgtaagatcacagtatacatacacagaaaatgtgtgttcatcgactgtttatatcattggtaaggcttcctgtcagcagtaggctattactagttatgttgtggtgaatcaaaagttacacaagggctgggctgggctcaatggctcatgcctgtaatcccaacagtttgggaggccaaggcaggtggatcacttgaagtcaggagtttgagaccagcctggccaacatggtaaaatcctgtctctactaaaactacaaaaaaaaaaaaaaaagaaaaagaaaagccaggcatggtgtttcacacctgtaatcctagctactgaggtggctgaggcaggagaatcacttgaacccaggaggcggaggttgcagtaagccaagatcgtgccactgcactccagcctgggagacagagtaagatgctgtctttaaaaaaaaaaaaaaaaaaaaaaaaaaaaaaaaaaaaaaaaaaaaaagtgatacaaggattttcagctgctcggaggttcaaggttcaataccttaaacttttgcattgttcaagaactaattgtctatgaattttgtaaaattgttcagagttgtaattattatctttgttgtaggttttaaggaaaaggatcaactcttcgttattttcatctctgtatttagctaagtttatgtccaatggggtaattctaaccatattttaagatactgccagcgtagattgtctctgttaccaccggatgcctctggagaatgctgcatgcatcaaaatcaagcagtaaggatgaaaaaatctgctctttcctgaactgaccagccttccctgactgtgcacactgattttatctcaatacagtccacaggcttttgtctttctatgagcttttccttctataataagaataggaatagaaaatgaccactaagttctccatcttccatcccatgcctcagccaaggcaagaaagagtgaaataactgctaagctattataaataactatctcctgtaaaatcatgaacatagagtgtatgtcagagatgttggaatcctgcatccttaatgtttaatggtgtttcctacaaatgttccctgagtattcccagtttggtgatatagtccaagctgcagagggaaaggatgtaacctgatattcatattcagttttccacctgatttctttggggattcacctcatttcctcaagtcctgctaatgtgtacggtggtaattccagcattctctcctcggaatatcaacaatgacagtttcttaattgctctcagtggattttatgtaggatagacagtgaggtttgaccacttgattcatttgaaatgagcaatacttccaccttgacatgatatcatatacttggtattttcatgatttattggtggcctggaccaatatactttgggtcaaaaggtgtgatttaaggaattcaacctaagaatagtaggccagctcattctcagtcattatgtgatttgttggaatattgtgaagttccgttgataaataaattgatgaaaaccttttttcttaccatgtaaccacatactgctttgcaccaatgattgggcacaaatataaacatattgctgcacagtaggtaattcaatatcaatatgtgtgtgtgtgtgtgtgtgtgtgtgtgtgtgtgtatatatatatagagagagagagagacacttttatccatttaggaagacaaacatattcataactatgttttccattaaagtatgttttccattaaaatgtactaaataggagagtaccttcctgtgtttccctgttttatccaaattctcagtgtttttaaagatcccattctggcaggtcatggtgactcacacctggcgtggaggtgagcacctgtagtcctggctatttgggaggcggaggcaggagaatcgcttgaacccaggagaaggaggttgcagtgagttgtggtcactccactgcactgcagcctgagtaacaaagtgagaccctgtctcaaaacaaaacaaaaaaaagatccaattccatccccatctactccaaaatgcctccctatttattcttatattgattaatgtattcttcctcaaaattatattactttctgactcaatatcatacaaaccggcacttatcacatcttgaaatttcccgaagctaacacgtgtctaacctgtttcccatattatgttttaagtttaaaaagattgtctgccgaccgaaaaagtttatgtcaaaactacagaaaagagccatttcttccatttctctaaaacatagccctgtgtcatctctgcttttccacccacccctaccccaacactcatcctacttaccttcctctggcattcacagagggctgagtttctagtagatgttaatcaaattctttgcatgtgattgctcagtctcttttaacttgaaaaggggaaggcagtgtaatagaacacaggaaggagctgttcataggttcagaagtcactcttggattttcaatatttgtgtttcattccttagaaagtgctgtcagttccctctttgaggagctctctgaaacaacaaagggacctgtcatttgtgcatacccccgactggcacctttgaaatgttatccagtcttgctacctaccatttctgatttgtctgacgttgacatgtacacaccctggagcaggtctgttgacttcactcaggcttatggaatattgcatacatccaccgtactccataaataactaatagtgtgaagcagagatcagatcaactgacagactttgtagaatgtaatctctggtaacactgactttaagaggcaatgagtgtgtgtgtgtgtgtgtatgtgtgtgagtatatatatattcccataggctagcaaatgaaaactgacagtgaacttttcctctagctctgatagagtgactggcattgggcatttcctcctggcataaacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtaatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtagtcccagctactcaggaggctgaggcaggagaatgatgtgaacccaggaggccagagcttgcagtgagccgagatcacgccactgcactccagcctgggcgacagtgcaagactccatctcaaaaaaaaaagaaaagagtggcagaagaaatgctagccaaactgcaggcagatcaagagaattatttgacctgaaaagcagagattaaaaaaaaaatcaaacaaaccgtatctcagtgaactagcaggacagcatccatgtggtcaaaatacatgtaagttgcgtctcaacaggacagaggagagaaaaaaattgtaaaataataaaacttttctaatatttagtgaaaaaaattaaaatgcttattttaaaatttcaagaaaccccactggtataaaaacaaagagaaccactcctatgccccaagataaccaaattactgaaaatctaacccaaagagaaaactgtcaaagcagttagagagaaaagacacgttatatacaaggaaacagttctaattaatagtggatttcttgtaagaagatgcagaataatattttagagtgccaaaagaagaaaaaaatacaaatctattgaccctaaattttatataaagcaaaaatatcctctactgtgggtaaaataaagacattttcagataagtgaaaaacaataaaattaagagtcagcagacctatactgcaagacatattcaaaagaagctttcagaggaaagaaaatgaaaccagaaaatgataattacagtatgacatgaaggataccaaaaatagtaaatatgctaataattagaaaatctatgtgtgtttgtttcttaattttcttgaagacacctgactgtaaaatgtatgacaataacaacatagaggatacaagtaactggaattaaactgttataaatgttttaagtttatgtaaattgatataatattgactgtatataaactatgagtaggtaaggatgcacattgtaatccctagagtaacaaattaaaaaataatgcaaagaggtatatctaaaaacctaataagggaattgaaaatggaaggataaaattctttgattatccccagagaaattagaacaagaggaatagagaaatagagattaaataggatacacagaaatatatgagtataggaaacttaaaactaaacttttcaataatttcactagatgcaaattaattaaacatccccagtgaataatcagttttagatttaaaaattgaagacataactgtatatctaaagggactttttttttttttttttgagttagggtcttgctctatcacccaggctggagtacaatggcacaatcttggctcaccacaacctctgcctcccaggttcaagtgattctcctgcctcagcctcccgagtagctgggcttacaggcatgcaccaccatgcccagctaatttttgtatttttttggtagagatggggtttcaacatgttggccaggctggtcttgaactcctgacctcaagtgatcctcccgcctcggcctcccaaattgctgagattacaggtgtgagccactgcaccaggcctacaagggactcactttaaatacagagacacagataggttgaaaaggaaagaatagtaaaagataaaccataaaacagtaagcataaaaaagctatggctggccaggcatggtggctcaggtctgcaatcccagcacttttggaggccgaggtgggtggatcacctgaggtcaggagtttgagacaagcctggccaacatggtgaaaccctgtctctactaaaaatacaaaaattagccaggcatggtggcgggtggcctataatcccagctacttgggaggctgaggcaggagaattgtttgaacctgggaggtggaggttgcagtgagctgagattgtgccactgcactccaggcctgggcaacaagagtaagactgtctcaaaaaaaaaaaaaaaaagctatggctatgttaatatcagaaaatgtagacttcgagataaggaatgctgttagaggaaaagagagatatctgataataataaaatggttaacttattagaaagatataaacatctatgtatatagtagctgagctttgaaatacctgaagtaaaaaactgacagaactcaataaattcgcagatatttggatattctaacattctcactcagtaactgttagaacaattaggcataatttcagtaagtatatagaataaagaacatagtcattgtgacttaattgacatttacagattactccaataattgcagaatatatatttttaaagtgcaagtagaactcacattatgttgacacataatataacaagtattaaatcttaaagattatgtcctttaaccacaagaaaattaaattagaaatccaaaacaataagatatttagaaaaagcataacatgtttagaaaataagcagtactctcctaactcatgggtcaaagaaagtacaggggtaagttaatacatattttaagctaaactgtaataaaagaacaatatgtcaaggctttctggatacagctaaagtagtgcttgttgagaaattaaagctttcattgtttaaatagggaaaaaaaggataaaatcaattatttaaattttttcttcaagaagttggaaaaagaaatacaaaacctctagaaagtagagaagaaaatgtgaaagaaaaaataaaatagaaaactgacaaataatggtgacaacttacataaatgaagagattcgatattatcaagatatcagttctccagcaattgatttatgggattaatacaaggtcaacgaaaattccaacaaggtggtagaaattgacaagcagattctaaaatttgcataggaattaagtgatcctagaatagctgaaacagtcttgaaaaaaagaacaaatttcaataacttccacaacctattttcaagatttactatgaagttacagcaataaagtgtggcattagcataagaaaagacaaataatcaacggaactcatttctgaagagtccagaattagacatacacatatacaaccattgatttttgataaagtaggaaggcctagatgaaattatggggaaaaatgaactttaacctctacctcacaataattaattttagatggatcatatatctaaatataaaagctaaaactaggaagcatgtggaagaaaataatggaaaatgttacaacttttgtgctggtaaagacttctcaagtagaaccgaaaaagttcctaccataaaaaaattgatcaattggactttatcaagataaaaatttctgctcatcaaaagacattgctaaaatgaatcatcaagggccaggtgcagtggctcacgcctgtaatcccagcattttggggggccgaggtcagcggatcatttgaggtcaggagtttgagaccagcctggccaacatggtgataccccatctctactaaaaatacaaagatgagccaggagtggtggtgtgtgcctgtagtttcagctacatgggaggctgaggcaggagaatcccttaaacctgggaggtggaggttgcagtgagccaagattgcagtactgcactccagcctgggcgacagagtgagactcagtctcaaaaaagaaaaagaatcgtcaagtaacatattagaaaaattatattcaattccatttgtgtgacaaaggacttgtatctacaatatataaatattcctacaaatcaataatttataatggacaaaagacttgaacaggcactttaccaaagaagatatctaaatggtcaataagcacatgaaatggtgcctaaaattattactcaccaggaaatgccagctaaaaccatactgagggaacattttaaaacccactggaatggttataatcaaaaaggttgacagcaccaaatattggcagggatgtaaaacaacacaaacgctcatacattcttggtgggagagagctctacaacaagtacaactacttggataattgtttgaaagtttcttctaaagcccagtatatagtgcccgactgcagtctactgcactcttaggtatttacccaacagcaatgaaaacatgtccatgaaaagacttgtacaggaaagtttatagcagccctactcataataccttcaaactagaaagaagccaggtatctttcaaccagataataaataattgtgatctattcatacagtgaactgttattgtgttagtcggtttgggctgctatataacaaagtgccatagactgggtggcttataaacaaaagaaatgtatttctcaccatttcgtaggctggaagttcgagaccagggtgtcagcatggttgggttctgatgagggccctctaccaggttgtaggctgccttctcacggtgttctcacatggcagaaagagggcaagagagctctctggggcccctttgtaagtgcactcatcccattcacaaaggctccccctccttgatctaacagctttcaaagaccccacctccaaataccatcacaatgggggttaggactttaacctaggaattttgatggggcacaaactttcagaccattaaagtgaacaagaaagaaggctgcgcttctaatacatgtcacagcagggatgagtcttagacgtgaatttcacacctggcatgaaggaagccaggcaaaaaggacgtgctctgtaattcagtatgtaagaagccccagagcagggagagaagtcagaacagtgattattatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcgccgtggctcacacctgtaatcccagcactttgggaggccgaggcaggtggatcacttgacatcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcagcaacagagggagactccgtctcaggaaaaaaaaaaaagaaaaggcattgaactgtacatttaaaatctgtgcatttcaatgtatataaattttacttcaaggaaagaaaaaggggacatgtcttggcatgtgcctcctttcttaagcctattaattataaaactgggttacccagatcctagaatatggctatgaatagggtagctgtaagagccatagataagaatctggggacttacgggtgttgaaaactcacggtggggctgacaatgattataatctgcttttttgttaccatttcagattatgacaaagcactggtgttcatcaggaaactaatgggagtaaagggtaaatagcttagtcaaaaatgcagctctctctttcaacatattagcaggaggccattttctggttttgtgcgtcaagcacaaagacaagcatcctatttgtttttagaaatcacatctaactttctttaggaaaggaactttaattttatagcgaatgaaaaatatcaattaacctattaattaacccggagaaactattagcctgggagataataaaattgcttttgaaaagattacctgacaactgcacaaataattactcttgcaaacatccggtgttctgcctttctctctaagatacttgagagagtttaaatatcaaagaatcctgattatttcatgagtattttcttcagctgttataaaaatcatgcttcagtgtttcagggattttgttttgtgcttgtcttggcagtggggaggaggggagcttttgtgtgattccaggtaaaagtatgctactcacagccttttgtaggtcatggcttcttgagaatgtgtacaatgccacggagcctgtccccagatgcatttccatgtgactatacacatatgcacacaatcttgcatatgatttcagaagcttggtgggctgctagaattttgtctcagatcctctagagtctagatgatggaggctggatgtaagggaggagaccacccttcatactgtcttatgcccaatttctgcctccaaagaaagaagaagtaaaaactaaaaggcagaaatgaaatccacaggcagacagcctggtaccacacccggggcctggtagttaaaaatcaacccctgacctaatcggttatgttatctatagattacagacattgtgaaaatgcactgtgaaaatccctgtcctgttctgttccgttctaattaccggtgcatgcagcccccagtcacataccccctgcttgctcaattgatcacgaccctctcaagcggactcccttagagttgtgagcccttaaaagggacaggaattgctcactcgggagcttggtttttgagacgtgagtcttgctgatgctcccagccgaataaagcccttccttcttcaactcggtgtctgaggggttttgtctgtggctcgtcctgctacagatgggcagccttggttctcatttttcatgccatctcctctaatggaaacaggaatgatctccccatgtcaacacctgcagtgtgggcctgcatttgggagggcgtgtgggtgcgtgcgctggggctggctactggtgtgcattgcccagagagtttatctcagaagtctttgacaaaggcacggttggcttcattttctgtctgtgaattcaagtaggagacaaatggatttccttactttttctgatcctgtgtaggaactgtagaaaaatgggtgtttctccctagttagaaagaaatgcttttcccaaagatgaattcagacagctttatttaatggaaaaaaatgtcttgcctgtttctaaatgcattcttccctggtggcttatacctggcaaagagaaaaattagtctcttgactgaatgaagtccccgtcaagacgaaggaaaagagagaagtgagaaaagaggctagaagagccaggattgaaggcatcgtgctgggggtggggtgcgtgctgagggtaatcgttgcctggaggcacataggctagtccatcagatccaaaattccaaagcttggctgtgtaaagaacaacatctaggagtattgagaagcaatgtgggcagtgctgagattcaaaaggggcgtccctagtcccaaagacgagccccacccaagtgaatggacttcccgaaattatggtacctgtctgagcctcagtttctccatttgtggatgggaataatcacacaaagtattttgcagagcaaatgagaaaatgtttataagagtctggctgactgcgggaatgctgttatttttgagtttctcttcccttaacgatcaagaataattagagacttatagcagcctgggagaaagttatcaaagaaaggtgtactgtatctgcccaaattaacattaggatgtttcacgggagctacttatttcagaggaagagctacagatggtttggaagatgatgagctttggtgaatgctatgctctgagaatgatggaaaaacagatatgggagaaactagcaaagccgtgaagccattaaggaactgaccacctaaaagacagagtcaacaaggctgtgcaggtctcctagggagataagatggcatattagtcagggttctctagagggacagaactaataggatatatgcatatataaaagggagttaattaaggagaactgactcacaccatcacaagataaagtcccacggtgggccatctgcaagttgaggagcaaggaagccagtagtggctcagttcgagtcccaaaacctcaaaagtagggaaaccgacagtgcagccttcagtctgtggccgaaggcccaagagccactggtgtaagtctaagagttcaaaagccaaagaacttggagtctgatgtttgaggacaggaagcatccagcatgggagaaagatgaaggccggaagtctcagcaagtcggcttctcccaccttctcctgcctgccttactgccatgctggcagttgattacatccaatggtgcccacccacattgagggtgggtctacctctcccagtccactgactcaaatgttaatctcctttggcagcaccctcacagacacaccagaaacaatactttgcatccttcattccagtcaagctgacagttaatattaatcatttacagatggaaatagtgtggttcaaataagaacaagagcaccttgtgaaataacatatgtagaagccaaggcttgcaatgtacagtctagcagtggcctttcatggtagagagactcattcttgcataaaaatgaagatattcaattaacacatcctattggttgtattctataacagggtgagcacatttatttacttcagctaaattgaaaatcatggcctcacaatgtcacgtgtgtgtgtgtgtgtgtgtgtgcgcgcatgcgcacggtggtggtggttgtgatgaaatggaggaagaatatttgagataaagctaatctttgataaaattcctcctgttcagtggtgaaccaggattggagacagagaccaggggagctgccttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggcagcttaaaaaaacaaaaactacatgagagacttagatttatgcttgcagaatgtccaaatgagttggaaaagtaagactaacaaatctagaataaaagtgaattgtctttgccaatttcactgccccatgggcagagtcaacagcaactactgtcaaaattgttcttgagatccatctgtccctagacataactataaaaaccttaactcatgggaagagtctacgtggcagctcctttgaaagctttccttgctgtttaagagaagtctagtctgccagaataaaaataaaaatttaaaaatctctactaagacaaattagaagataatgcaaggaatattgggtaaacatggaaagaagggctgcctgtaataagcagtaaaataatcttaaacattctgtgcagagtaaacgcatgtatatacaattaattccaaggccaaagggagtgagtgacatagagcgatcacatcattgtctgaggaaccattctctgccaagaaaaaaggcaacagtctcatattcttctctagattagttgactgtgaaaagaaaagagggcaacaagtcagcttcccttagagaggttgttggtgagtgggacatgtgttaatgagacacttcacaccttccctggtaggtacctggagcaggctgaaataagcaaaagtgaatgcaggtgatacaggtgtggggggtgaggggacagtcttccctacctgcaggggaaagcctgtcaagaaagcccttgcagcaagaaggtactcaaattaaataatgcttgatacatactacctacacactaaccttatggattagtatttttaaaagtctcacctttgcatcctgtttgtgagttagaaatgacttgactagacgtgatttcacatatcacgatttttaaaaatatttgcaattttctaagaatatgtatatgactaaacttatatggtataaaccatactggtaaacatgatgatgatgatgaagataatgatgattgatgatgacaatgatgataatgataatgtgctctctagaaaaaggaacaatattccagatattttaacatactgctactgaattagtccattctcacactgtgataactacctgagactggataatttatgaagaaaagaggtttaattgagtcacagatccacaggcttaacaggaagcatggccagggggccttaggaaacacaattatggtgggaggtaaaggggaagcaactgtgtcttcacatggtggcaggtgagagggagagcgagagagagcaagcgcaaagcaggaggtgctgcaaactttaaagcaaccaggtctcatgaaaactcactatcacaagaacggcaagaaggaagtctgtcttgatgattcagtcacctcccgccgggcccctcttctaacgcatagggattacaatttgatgaaatttgggtggggacacacagccaaactgtatcaaccacatttatttatcacagcagctattattatccctgttctatatagatgaagaaatgggggtttaacaaattgcccaagatgatagagctttgcccaatctatccatgtaccatcaaggccatagctttgcccttattttgcttgaagttgaaaatttcttttatattgttgtttgattttgttgtattacaaagccaaatctaaagaatttcactgtaataatatgcatagtaggtgtaattagaggtaggcttactttgtttatttatagatttagtttgcaatttaaaatccatgaagtgatagcatgtgtcatagcccatcatgaatttcgaatgaaaacactgtggctgtactgagcttctgagaaaaatccaagcgggtaagcaggagttctgagatggagatgcacaatcttaattacattagctgcctccttgggctattttgtgtatgtagtggggtgggcagtgggcttggttcttaatgtaatgagtgatttcaccaaggagggagacagggcttgacttgatgtgtatgggtagtaagtggattactagaagacttaagaacagggaggttagaggaaattgtcacattttcactgggttaggaattttaaaacaaaaatacgagcttcaatgagagaaggaacatacatggcctattttaatgatcatgagagcaagagactgtctgaagtaaggttcaattgcaagattcaaaggtaggacaatgagcatgttgaaagctaaggagaggaataagtgtaggaggaatacattattagggaaaaggaaacgcaaattgtatttcctttgcaatttgcaaaggaaaatttgcaaattttccttttgcaaaactaaagagaattgcaaaacgaaagaaaaggagagtgatgaagagaaccacatgggcaaaaaaataaagatgtagacaattctggatgatgttaacaaatgaataaaggcatgtgccagcagtttgcttagggcagctagtctattcagacagagagttacagggtccgtccgaggggtggaggcacaggcggctgtggtggaggggtgctggggctgaggtccagtgagctgcctgcctctgtgtcaagaaagaagaactgaaggtcacattctggaaacagaaatccactttcctaggggcagtgtgaaatgttaaaaggttttatgttatgccagagaggatagttagacaattagagttatctgaaggttgacaaggcagcaggcttagatgaattacactccagcagtgtggagaggaagcgccagtgaaatgtgaaatttggagaggctgagccactcccagcactgggggaaaggaggtggctctttgaattctgcggtgcgggaatggcagagcacacctggaagccaggagggagcaggtgttacccttgaaccaggcagacgtgggggaggcccaggcgtctcatctctcccctcctcctgccctgtgggaagagcatagtccccctctgcctttttctttccttttgtcttcagtccgccctccctgactagtacatggtcggtcaatcctgtcatagaacagaaactagatgtttccagaatttttatgccacagcgcttgaatgttctattgtttcacaatgctttgacacttagaagacaatactacatagtagacacttaaaataataggaaaaattgtctgtcaaataaatgacttagaagacctggttactatgtccaataaatacttggtgttttattttactcacccctcttaacttctccttgtttcaacacctataaaataagaagagtaatatctgcgctctttaccagttttcctgaagaccacatgagataaatatgtgaaaacacactatgaaaagcacaaaatgctttataacctatagcattatttttgtaagaatgaagcaaaactgtaattgtgtctgaaatctaagaatggatagagggaagatatattccactgtagactcgaacatgatttgattaaagtctgactataagaggagaaaccacttcctgatgaattatgagacccaatttaaggaataaattattggattggcttttaaaaaagtccagtagtggccgtaatttatcttgattagtggaaaggtttcataaactacagtgtgcaaaatattgatccatttagtaagtacaccatgcaggggcccctgcagaaggcaggcacctccagctctgcagagggcagcacagtggcccactgccttttatcacagctgtggaaccaaatggaaactggacgccgtcacggaaaacgatcagtctgcatgacgggcgcatggaaaggaagcctgacatttgaaaacacgtttcttccaaatatctttaaagatttctgaaccagagctcacccacctatctgtagcctccaaattatgaacagaatcatgacagaatttgggtttgtttcccagtggctctgccttcttttgttcttaaatattttttccaaactctcagatcataaccaaataacaaaggaagcagctgtgatgctcctacactgtggtaagtcccctttgagaatcgtcattgtggaaaggagagaaacttagattcttgattctcagtaggtcgttcttgatgaacacttgctaaccccaaggcattcatttactggagcaaggttttgtgcatttcagatgtcagcctgagattctggtaagatgttaggaagtgctccagctgggaattgccaccatagttccttctcagcctcactttagagaggtcaagtgcatctagaaaatgccaggctttagagtgacagcatgaaatacccccttgggttcttttttctttttctttttcttcttcttctttttttttttttttggagacagtgtgtcactctgttgcctgggttggaaagcagtggtgtgatcatagctcactgcagcctcaatctcctggactcaaacgatcctcccacctcagcctcctgagtagcatgtgccactatgcccagttaatttttaaaaacatttttttgtagagatgagttcttgctatgttgcccaggctggtctcgtgctcctgcccaaaagggatcttcctgcttgggttctttagcagaattccagaggctattcctacctgttgtaatgaaacttctcgatttgctctcctctccaaccacaccctccccatcagcatcttctcatctgccctctggggatgtggattcccttcggcctatgaaggcaggtctcccatttaggatattcaaaagcggtctggtgcgggtggctcatacctgtaatcccagcactttgggaggctgaggcaggtggatcacctgaggtcaggagttcaagaccagcctggctaacatggcaaaactccatctctactaaaaaatacaaaaaaattagtggttgtggtggcatgtacctgtaatcccagctacttggtaggctgaggcagaagaattttctgaacctgggaggcagagattgcagtgagccaagatggcgccactgcactccagcctgggcaacaagagtgaaaactccatttcaaaaataaacaaataaataaataataaacagaatatgcaaattcaactccaaacccaaatgaggaaggccatcaaataagatagaaggtaatggttcccactatttgagtaagacagccacatggggacaaatggcttgtgcaatttagtggagtaaatggcacggccacatgaccttgtttggcttctgttggttagcagagatccttggcatcagccagatccatttgttttcttgaatcttagcttttcctctcctttgtccccaaatatcaaagggcaaaccacttgacatcatttctagctgtcatttcccaatgcagtagttttaaagcctgaaaagccaaaggcaccactagaaattacatatattgtggggcaacacgtggaacttaaagaaagtgagcatgaggaggagaggagagatgaggcgaggcgaggggaggggaggcgaggggaggggaggggaggagaggatgaattgctgccaggtgctgccccacttttcatacctatccaagtgactcttccagattctaagtacattcagattgtgttttagtgaaatgcagtaaaacaaacagatgttaaattgctttcatacatatcttgttttatccccataacaattcagtttctggctttatcatacctgtttgagagatgaaaaaacaagactcagtgagatttatgctccccaccaaaaatcacagcaaattcaccacagaacctgaacagtaactgagatcccgtggaaggagagcagaccagggaggctgacgttgttataggagtgtgtgcattttacctattagttcaaggggttttgttggtgttttatcatgctccacaaccaatagcaaaagcaacaaataaatggtataggacagtgcaaaggaataggatcatacccaagtgcgttttaacaaaataagtaaacaatcagtaaaatgtatctgggagtgctggctccctcagggcccctggaacaggggtgcatagttaagaaatatacagagttctgctctaagaaaacgtgtattccttaaaaaccaccacattatacaaaatcacaccaataaaaacacaacagtaatgagagaaatggggttatggacacaacatttaaatatgttgtcagtgaaaaataaaaggaacatagtaaaaatcggtagcatagtttcacacaagttatatggttaagaaatacattgaaactacaagatatatggcacttcaccttgaaaaaagccccagagttcactcggaggagtaagagctgaaaaggctatagttgtgagtgtttgggaagaggtagaagcaaaggtgttgaaatcggacggaagtaacaccagacatggatgcgtgtggcctgtcacacgcggagaacccaggcagtggcagcttgatggtgtgcagccatgtgttttatgaatttctacagactcaattcctgggctgcaagcagtttttctgcattcacttagtgcttctcccagaccaaatcacacatatgcgaacaggaaattaacctgatgctcaaattgttctctaatctatcaattacattgaaacaaagtcacattttcaaagcaagcattttaacagaagtgactgcacctaggtcctccctctacggagcttacagtctccttcagaataaaatatggacaaataggaaatactggattcgtaagtgccaaactaatatgcaggtgttttggaaagggaggggccgctggggcagtcaaagaagtttgttgcaagaggcaattccggaagaaatgacctaagcaaagtcagagaagtggaggtaattgtgatgggagaaaagagaggaagaggtagaggacagagaggacagctgctcaggggtgaatgagaaacaggtttgagcagaagctgggctggctgtgataaatactgaggaatgtcactggaatgtcactgcaaaggaggtgttttttaatgtttgggtgtaaatcaagtctgtagcacagactgagggaatgaatattttacagaattgctgtcatcgttctgtatcttacagcccattctgttcatttctcattcaataatatttattgagtttctgttgtatgccaaacgcgttcacaactgtggattcagctgtgaacacaacgggtgaagcatctaccgtaaggagtggacatcctagcagagcaggcacgtggctgctggttaaggagacgggcacccagtgagctcaaaaagcagccagggctgcggcatgaggcagaatcaggagtcagggaaggatgagccgtggaggaagatggctgtctcagagagggtggccagagaggtcctctctagagaattgacatgtgaatcccgaggtgcccaaaaggagtgggagcaggtctcaaaaagttggtcccaggcaggggaagcaatggatggaaaaatctgacatgtggagaggcagccacaagtctgtggggtgggagcggtaggagaggatgtgggctggagtccatgggtaggagttggggctttatcctcagttccgtggaaagctgccaggtcatgttgagcaggagtgtgttgtgatcggattcactttttaaaaaattattttatttccataggttattggggaacaggtagtggttggttacacaagtaagttctttagtggttattcgtgggattttggtgcacctatcgcccaagcagtatacactgcactcaatttatagtcttttattcctcacccctttccactctttcctcctgagtccccaaagtccgttgtgccattgtgtcattcttatgcctttgcatcctcatagcttagctcccatttatgagtgagaacatatgatggttagttttccattcctgagttacttcatctagaataatagtctccaatctcacctaggttgctacaaatgccattaattcattccttttttatggctgagtagtattccttcgtatatatatataatacatatatatgtataatatatattatatatattatgtatatataaaatacatatatatgtataatatatatattatatatattcttgcaattgtgaattgtgctgctataaacatgtgtgtgcaggtatctttttcatataattacttattttcttcttggtaaatacctagtagtgggattgctagatcaaatggtagttcttttggtgtattttgttgtttgtttgtttgtttagatggagtctcactctgttgcccaggctggagtgcaatggtgtgatctcagctcaccgtaatctccgcctcctgggttcaagtgattctcctgcctcagcctcccaagtagttggaactgcaggcacatgccaccacgcctgggtaatttttgtatttttagtagagacagggtttcaccgtattggccaggctggtcttgaactcctgaccttgtgttccgcctgcctcagcctcccaaagtgctgggattacaggcatgagctgccacgcccagccaattcttttagttttttaaggaatctccacactgttttccatagtggttgcactagtttacattttcaccagcagtgtagaagtattcccagttcactgcatgcacgccaacatttatttgctgggataattggcaagctacatgtaggagaacgaaactggatcctcatctctcaccttatacagaaatcaattcaagatggatcaaggacttaagtctaagacctgaaactataaaaattctagaagataacatcataaaaacccttctagacattggcttaggcaagaatttcatgactaagaacccaaaagtaagtgcaataaaaacaaagattaatagctgggacttaattaaactaaagagcttttgcggggcaaaaggtaaggtcagcagaataaacagaaaacccacagagtgggggaaaatcttcacaatctatacatctgacagaggactaatatccagactctacaatgaactcaaacaaattagcaagaaaaaaacaaacaatcccatcgaaaagtgagctaaggacatgaatagacaattcccaaaagaagatatacaaatggccaacaaacatatgaaaaaatgctcaacatcattaatgatcagggaaatgcaaatcaaaactacaatgagataccatcttactcctgcaagaatgattcacattttttaaaagataattttgcttatacttggagaagctctaggggaaaaaactggaaacacaaagaggaggtatgggagagttgatggtggcttggacctgggtggtggatgtaagcagggaaggaaggaaggaagggagggagagagggagagagggagagagggaggaaggagaaagaagagagctggattcagtgttttgaagttaaagcccacagggtgcactaatagactgctcgtgaaatatgaaggaaagtgaaaattgaggataacttcagctctgcccccttccccagaactgagtagatggagatctaatttactgcgatgtggatgactgggagggcggagtgttgtgtggactccccaccccagattcatatgttgaagagctaattggttgtgaggacctcagaatgtgactgtctctgcaaatcgggcctttaaagaggtaattaggttaaaatgaggccatagaggtggaacttactctaatatgactggtgtccttatgagaagagaacatttggacccacagtgagacaccaggaatgcactgccacagagaaaagatcatgtgaggacacagtgagaaggtgccgtctgcaagccagggagagaggcctcagaggaatccagcccagccggctccttgatctcgggctttcggcctccagaactgtgagaaaataaactcctgttacttaagccactaagtttgtggaaagagagaactcaagggggctttattttaaatatgttagaaagtgtcaaatgaagttcaaaaaaaaaaaaaaaaagactagagactctaggttaagcttacataagagacccaaggacagcaaatcattttgttggggataaaagtgatatttgtaggcaataatgcagcttctctgattttgtactaaatacgttttagtaatttttttgtggcccagctgaggatagcttctcgagatacccttatggtttaactgtatttttcacgcactgttactggctaaggtcagtggatcaaagagacacagtagtctatgcacgtttccgatttattaggttacgacagtggggaaactttctccttagtctagtccatgaatctgctcaccaatgaaaaggaaatatagctaggaattatagcgttactgactccgtaatacttcaataaaatctgttcccagtttgagaaggagtcgggcaaacacaggaacttgcttaaggaaaataaccatgatatagataaccaacagaaagtctagagtaagaaacctaccccactccctttctagcagtgattgcctattacaggagaaaacagattggaagaacaaaggggaaagactcaacagaaactgtaatgtgacatagcttagtctcctgaaaggagcaaagaaaatcagctcaggagtaaatcaggatctctcttctcttgccaggacaaattcttcacttttaagatcaagattagggagctgattagaacaggttagcttctgtttatatatgagcagtttttaattccatagccattttagaagaaaaatctgagtaatcatcgcctcaatgacagaagctagatcaacctcccacaagctgcagctttagaatattggatggaaggaaattgatcctgagatgtggaatcccacaatattttcactaacaggtttccatgagaagtgggtgcttcattcattcttgtctacacacctatttctgcacttcctcctacaatatctcttttgagccagcctcagaccaaacacgactgcattccaaacagtcctctgttatgttctttttattattattattattattatttttgagacaaagtctcactctgtcacccaggctggagtgcaatggcacgatctcggctccctgcaagctctgcaacctaccaggttcaagtgattctcctgcctcagcctcctgagtagctgggattacaggtgcccactaccacacacggctaatttttgtatttttagtagatatgaggtttcgccatgtttgccaggctggtcttgaactcccgacctcaggtaatccacctgcctcagtctcccaaagtgctgaaattataggcgtgagccactgcacccaaccttgttatgttcttttcttggaggtctgtgggaactggtatgaaggtggtacactataaagaaaataacttacatggccaactagagttctgaaaaaccctcttctttaacacaattaaagctcattaaggttatgttgtgctgcaaagtggccttttcaaagagtgtgagaggtgcattttattcacatatatttgcactgagttcaagtatccctaattctcattatgtgtaatgcatttactgtgaaaagacatagaatattgaaaccacaacatgacatgcatacaattcataacaaagctttcaagctatgaaatatttcatggtaggacagagaagcacactccgagttctttgtagtagagttatttggtgtcacataacgattaagaacaatggctccagtcacaaaggcttgagtttaatccttgctcaacttttaattggctgttactttggacaattactctctcttaagcctatttccacttgaaaaaaatgggtaataacaatgtctgtcttgtaggattactgtaaagatgaaaattgtattatcaaaagctgagtatagtgcttggtatagagtgaagagggcccgcattggtatctgtgatgatgatggtggtgatggtgatgatgatgttaatgatgttaatgatgatagtgataatgatggtgatcctgatgatggtgttgatgatgatggtgataatggtgatgataatgatagtgatagtgacaatggtgttaatgatgttaatgatgatagtgataatgatgatgatcctgatgatggtgttgatgctggtgataatggtgttgataatgatagtgatagtgatgatggtgttaatgatgatagtgataatgatggtgatcctgatgatggtgataatggtgatgataatgatagtgatagtgatgatggtgttaatgatgttaatgatgatagtgataatgatggtgatcctgatgatggtgttgatgatgatggtgataatggtgatgataatgatagtgatagtgatgatggtgttaatggtgatggtgataatgatggtgatcatgatggtgttaatggtgatgatgatggtgatgatgatggtgatgataatgatagtgatagtgatgatggtgttaatggtgatggtgataatgatggtgatggtgataatgatggtgatgataatgatagtgatagtgatgatggtgttaatggtgatgatgataatgatggtgacagtgatgatgttgatggtgttaatggcgatgatgatgatggtcataatgatgatgatggtgatgcttctgatgctgataatgttaaactgaaccaagtctctctgaaatgaaatgtggtgcagccttcttagatcattgggcaaaaagaaggcctctcaggacatgtttctgctgtagcttgtgccactcaagtccttgggatgctttgtaataagaaatgaaagttagctgaatgtattttacagaaatgcaccgtttaatactcccttacataatgcaggatcaggagatatagaagtagacaatcatgttgtaacttttaataaattgttcaatcatagtattcaatgctgctgcaccattgattgtattagcaagcatcaaaaaaatccttaaatgataatgtagccgacttacacaaaataaacttaagattactgttttggtcaaagaattttcttgggtcagtagagggagatgaggaaaagaaaaatattttattatattgtagtatattaaataggttttattgtatttctttttaaaaaaatatacaagtgagtattctctcaaaccttagactttttcaccctggcctttcattgttacttgactggctgttactttggtcctatttttaactagcaaaagatcagacaaaataaagggaagaaaagacaattatctaaaaatgcaacatgtacaactgcacagtctagaaataacttgggtgtccacatgtgaggtaagcatctggaactagcaaaccatggtgagacattgtagactcatccccctcccattatggacttgacctcccatcccatgctcctggagatctggtctatgatgagatttctctcatatctctatgagagatactgttgtcgtttccttctgagtatctataggtgattaactaaaccgatcagactgggaactcctccagtgctacactgtgtacactggttgaataaatgaatgaacatataaaagaacaaatgaaaccatatcaggggtgtcctcaatttggggagatgcttgaaatcaatctgtcttatgaaggaactaggaagggttacagtcttattcaccaagatctggcgcaggctttgaaagaagggacacctgacctcaggtgatccgccagccttggcctcccaaagtgaccccatctctactaaaaatacaaaaattagctgggtgtggtggtgcacacctgtaatcccagctactcgggaagctgaggcatgagaatcacttgaacctgggaggcagaggttgcagtgagtggagattaagccattgcactccagcctgggtgacagagcgagattctgtcccaaataaaggacaaagaagaatatttgttcattctgtacacttggccagagatgtttttgactgaaattcattggttaactaacagtgcttactgggttttatcacataagttcatataaatcaatcaatatgattacatatctgttcaatgaaatgattccaccagaggttctcaaagtgtatctgaggaccctgggggtacccagcacctttcttaggacatctagaaagtcaaaactattttcataatgatatcaagatgttatttgccttttgtactttcattctctcatgagtatgaaaaattaatcaatttggtttcagagtgcacattacaactaaccttgtcaggttttgatatagtatcaaataaaaatattcgcagttatctgataaagcaattaaaacatcctccttttccaactacatatttttgtgagactagatttcttttatatacttaaaccaagagtaatatattgcaacaaattgaaagcaaaagcagatgttggaatctggctgttttctattgttttccttcttctattaaagtcaaggttactaagatttgtagaaatctaaaacaatgccactctgctcaccaaatttttttgaaaataattttgcataaaatgtgctgattatagtaagatataatagattttcattttgaatacttaaatattcaacattttttcattttattattgtaaatatacaataattcacaataatatattacaatatataatatatatttacaataaaattatatatttactgtaacaaattatatatatatttatcccttatatatattttatatatatcccttatacacatatacatatacatgcacatacatatataatgtgtgtatatatttatctcttataaacacatacacatgtgtacacacacacatatatgcacacatacttatatatgcgtgtacatatttatcccttataaacacatatacacacatgtacacacacatatgtgcacatacatatatatgtgcatgtatatatcccttacatatacacacatatacatgcacacatatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatttatgtgtgtgtatatatttatcccttataaacacatatacacacgtatatgcgcacatacatatttatgtgcatgtatatatttatcccttacgaacaaaagctctttggggtcctcaatagcttctaaaggtgcaaagggtttctgagaccaacatgtctgaaagccactgaattaccttaacagctcctaggtctgaaagtttatggttctaaaaaatgcccagcacttgctgtttctatgaggaataaaagtgattgtctcaccatcaacactgtctacaacactgttagggagacaaagcttatctacatcaacatgatggattagctacttttcttagttctttctagctcccacaacaaaataccgtaaactgggtggcttataaacaagagaaatgtattgctcacggttctggaacttggaagtccaagatcaaagtggaaacagattcagcatctggtgagggcccgttcctcattgacagtcatcttgctgtattctcatatggtggatgggactagaggtctccctctgggatttcctttataagggcattaatcctattcaggaggtaacattcatgacctaaccccttccggaggccttgcctcctaacaccatcacattgaaggttaggattctgacatagggattttggatggatgcatgcattcagaccacagtgacagcctacaatcaagttctaaattgtgtagttcaaactaggagaactgtgaggagatggttttggggaaagtgacttctgcatttgcctcaatgattttccctgcgatgacacgtggcctgctctgaacagtgtttgttccacaaaatgctgctgtcctttattcagaaactttctattgaaaccaatttttatctcaataacctgatttttaatctcacaaaactggacctggtgactttgaattactatattagaaccttgtaaattgccttgtttactgattgttttaacacaagatcctgtcatctcactagactatgtaaatttgcagataaaaatgcccatcttagattggtcagcctgggggtgaaaatggactcaaccacttctatctattgattaaaggactctgagtaagtctcctaagtatatgtttttttttcaatctgtaatatcaggatgttagctgtcatttttaagcccctgtgatatcccatgtgatccaaaagacactttgtataattcatcaattctcaaaacaacatgctgagataacgtaattttcattctctataaatggggaaaccgaagatcaaagaattgaatcatggctaaaaccacacaactggtaagtggaaaggagttccacttaaattgaacttataactttgatctaagctgtctgattctaaagctagtgattattttcctattattttgatggtcagctcttaagagttcttgcaatagttgaataaagtgaagcctgtgatagcctagtgcgatgtcaggtacgtagtcagtggtcactcagccttggttccccttgtcctgcccttctcctgggccacagtgctttgtagagctgtattgtaccatcccagtaggtttagccacacagagcccatgagaacaagctttgcacttagatatgctgtccatgtatttgacaattgatttgctgtcctgactttgctattacctatcctcctgatcatggacaagttcctccgcttctctgggctttggctttcttttctgtaaaaggatgaatttggacaagattaccatcagatctatagattttctaccttatagatctgtactattgctgagatttttgtgacaagcttaggagttccccaaaataatgaaactgtgctatttgaacattttctctgaatctcagaggtacaaatttggaaatctacattgtcattaaggaaatgtgatgtataagaaaaacagtaaagtatagctgccgtataccgtacttcttaggtataaaattcatgctataaaatgactttcttcatctggtgtcaaaccctaaataatgggaaataatgcaaaggaaatatgtttcctgatagtcaatagaaggaatgacggacccagcagccatgtgagggtatatttaaactaagaccttcatttcatgcttctcatgattctaattctcattttcccatcgagttaaagggggaggattgagtttaacatgtgggaagagtaagatgccttggttcttccattgttagttttccatattcaccatgttgtataatcattaagcgtatttaatcgtggttattgagttaaaaatgaagtgttaccacccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgcaaagaggaagagcctattgaaatcagacgtgggcaggtgttgagttctactgtgatttgctattttccatcatacagagcaaggacaaccagaactgcaaagacagaggccagcagtggtaatgaggactgaagagaagtcccagcatggacaggaggcccttatcatttttaaacagcacaattccctccatcttacctttggcactggagataaatgaaataggctgttctgtttgaaaagagtgtacctgctcagtgggaccagcaagcaccatgtggccatactgtgacagtcatcaaaagaaagagtgcaccttcctttgcagtgataagggggtcacagagaaagcctgggggtcaaagctagatacaaggcatcaggctgccactctcatccagggacacaaacattcttgtctccaatattggatctgaaagtaaaatcaacatattctgaaggaaaaggatccagtgaaggaggacagtattattcagggaggccttgctatacctttatctccggggtttcctgccttacaggaagatgttgccttatagaaagatttatgaatgagatgctttgatgaaagtctgtaaccaaaactcttagctatgtggatggataactatagccagcttcctggtttcaaggaaaaagttctcaaaactctctctacattttgcatcctgaaataatcaatgtatctacctccctggatagacaattagcttcttgagaacaagtaccctgaattgttcactttcaattccctggctgccagcacagtgccttgaactgaactgagcttctacctaagcatctgtatcttctgctaaaagagacctgcctgctccatccatttttaacaggactctttcctaatatttgcttttaattaaatggaatattcatcaaagtgaaaaacatgcttcacttagtacattacctcagactacagagaacacacctctgttacttcttatggtccttttgggacagctgtggatttagtttcatagactttattagcataattgaaaaagacaatccgaggggaagcattttgtgcaccgcctggatggaaattatatgaaggtggcattaccagtactgtacttgctactaaaatttcacctaaagactcattgcaaagcacttgggcaaattttccttttctcacttggaattcaattttgaaaattgggggatgtcaagaatttcactgaatgaggttcatttttaaaatcccattatgagagggcagtgtagggggactccattagccccaggagtgttgaggggaaacgtaaatgagtgaggccattaaagtccttagaccacgggggcctcaatagagcctgagatggctgctgaggaggtggagacatggtcatgataaggactgactcccagcccagaggatgatgagctggtgcgtgttctcatgctgtgtcaaacctccttgcatatcaatcttctgttcaccctcacagccaatcctgaaatccatcctgtctccacatctgtggagtttcctgttgcatggagctcctcacaaaagtctactttccaagacagctttccccaacccagaatgacagtgggattcacacattatcaagaaaagtcacccatttcattttgttcccactggagtctcttttatcacttccctcacaaatgattctggggatatttaaactaattttctagtgtagaagaatttaatggatgtgtggacaccatgaatacagctgctgctcagtgcctgtacttgcttttgtccccaggaattgatttgagtgcaatcaatttgcaattcccaataatgtagagagctgcctctttgtctcagcatctgtcctgctaactgtgaggcccgacactatggtgaaggaggcagaataggaaaggaagagcttctggcatgagagacagaaaaagcttcagatggaggatcaggaccacaggcacacatcccctaaagatcatggaaataatgacaaaatacaacctgcgttacagccagctcccctagcaaggtgtttattctgtgcaacaagacacgcttactctcaccattaggatcatcattagctttaaaattgtcaagtgacaattacccatatattgcggtgatacactttttatactgaagcaaaatacagtcttatggatgggttattttctgtgtaacaatgcacatcattctgcaagatgaccaaacaggagagaaaacaattcacgttctgtagattacttgattgtgccccattttgttaatgggcagtatattttaaactacaatttcaaagtcaaatgtctgcattggttgtttctttaagtgtaaagagatcagaaaaaaagggtttattccttagaatgagtttccctgagatgtagcgaggacattatagtcagactggcacaagcaaagaaacagttacagcagcaccaacaattaggagaaaaattggactccaagtgaaacaatgctaggcgtctcactataaatgctatcaacactttgtgtgagacaggtgcagagtgtgaaagcaatcattcgtacagataatcactgtatcaaatgcgtgtccctgcctggactgcacctgccacaccttttcataaagccaggaagccagacaacagtgtcttgttgagggttggctgtaccatatgggaactgtgagccctgcaccagcatcaggtggtgcttctgttatttgctctctcactgatttagaggagtcctgagaaattgaggtcctcaacagaaaacacatgggtcagtgttaattcatctccagtgacctttgctgctgtggaattctgtagtcctgtctctgttccttcttttatccaaggcttctcattgcaaaatggaaaccgtattgtcaggttctaagttctgagcagcattttgattgggattctatagttcctcagtcatatcactattcttatcatggtgataccaatacaattattacaaatgcaaatacaacccccagttttcctgcaatagaatatgtgagccatttcacactggagttgatctacataaagtcagctgattctaagagctcagatccatacacccgcccctgcctgtcaacatggccactgaccacgctaacacgctgacgaggtgagtccttcacctcttggcaaccagaagtgttagaccttgaattttagcatttgctgaatggagatgcttccatgcactttagaagatttgattcttctgcaagaagaattctcctgttaaatatgcaaaatacgttttttttcttgttctttggcactagttaccaaaatctgcaagtctgtctatttttaatgtaccttcttttaaaagcactgcagtgcctatgtgtatattaggctctaaacctggctctgggaggtcatgagtataattttagacctagcaagttctgaagtcactgtttctcttgtatttcacaatgaaatgtcaggaataattttttgaaaatgaagtggaaccttcttttaaatacgagcccttcatctccatcactcctcccaggctctgtcataatcacaggccgggagctacatttctggctgatgggatccttgtgcagttggcacaggctctgcccccatgcctctggaccctcagctgtccttgcacacctgctgcaggtgcactgtcatgctcagggcagcacctgtgtcctttcattggcacttccggcacgctgccagagctcttactgcccgcctggcctggtggctggaaatgcctggggattttgcccctttgggcagcctcagccaaggactgccagatgtggggaaatatattccagcctcctttccccagcagcagctctgaaggatggcctacctgctcctagagtcctctgcagggctgaggcacagttctacctgtgtgacctccttccctctgtgtcccctccccatgggtttcccttgaaacacatcttataaaatcacttacctagaatacacatttaagcctccttctcataacccaacaccttggcccaaagagcggaacaaagagccggaaccctggggagttgtagcctatggacaccaggtctcggggcctctcctttaaggatatctcttttttccaaacagagtttaaagatgtccttgttccaaattgagaagacaaaaagcaaactatgttgcaggttttccaaatgatttcagaccagatttacaatggcttgctctttaaaaattgaagaaattcacccctggtatgccaggagcctgggagtctgcaccaggattgtcccctgcagatgtgaggacagtttaatcagctccctcctcagtgctccatactctgtgagacgttgtggggaaggcagcatttaaatctacaaataaaagtactggatccctcaagaggaggagagagtggtacaaccttaatggccttaaaggccaagaacttaatggccaagaagccagacatggagatatccatggccattctcaccccactctttccttcccactgcaccagcccctccggctccaaatcaaatagctctgaattcagaatgcaatttgaaaacttgggaatcaaggctcttctctgtggatcttgtatttgagatagtaagaccttgccagtgccttgaagttatctatttaacctagcatagccgtcactttggaagagtgaggccagcactccaggctacgctgtgcatgagaatgaggacaattttgctaaaacaatacaatgcttctttactgagggtgggtctattttgttttaagcttatggatattatcttacaaatacctgttaaaaccccatgcgtagttaataatcccattttagaaaaaaagccactttgacattgaattgctaactgatttttcccaaggtcaccccagtaaaagtgtcagattctgaaatcagattctgtgctacttgatgttaatgccccgtaggcctctcaatcataaaatgccttagagtcacagtgggtgtgacatacgtgaagttgaggaaagaacatttcccttttgacagccagaatagaatcgtttagcaaatggcattgataaggtcaataattcaaatgggaaattagagtattattctgacctcacaatagaattgattaggaaatggcaatgataaggtcaagaatgcaaatgggaaattaagagtgttattctgacctctagggtagagaatgggacctctgctcagctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgcttgagcctgggaggcagaggttgcagtgagccaggatcacagcactgtgctctaacttgggccatagggtgagattctgtctccaaaaataaaaaactaaaagaaggagaagaggaaagtagtcttctctctcttgctccagcagttctgaatcacctttgtgtagtttcttgatgttcttgcttttcctgtgcaaatgggtagtgaccttaacagtgcatactgtgctgaaactctccccagtgagagttcttccacatattctgagccatgctgaataatcaggcaggtgcacggctttgcccacactcaagtgaggaaggaccatgggactcttcccgtcatgcgggcgacagatgtggttcagccactgcaaaataaaaagccaggccctctgtataacgaaattcagtgaccactttgtttcattaagaggcagtctgttctgtggacctgggagggagagacagggagcgtttttcaccaacaacttacaactccacagtaagttgagaggagtcccgactccatgctgtatgaagtccagcactgacacaccatggccagcgaccaacttgctaagtcaaaaaaatctaactcagaaccctttgactgaggaacagttttcacactccagaaaattctaaatgactttcatttgctgttggttcacatgccctcgtggaagactttgcttgctgctttgttttcataagcagcttgaaggaaactcaggcaggaactatggaactccagctgctgctgtaactgcatcttgacgatgcaaaatgacgatggaaatatagaagcatgtacatcatatctatcatgaattgagcatgtgggtctgttccctcgaatgaaaaatacatgcaaataaaaatatttggctataggtggtgcaacttttaacagttgttctagaacttacacatccaaatatgtgttttcactttgcacagggtggcctatggagttttatgcttgctctagtaatgttgtagtggaaaacattttggaagtattttaatgtattaaccacattgtttaatatctttaacctcattaaatcacagtcctttaaggaatgatatgtgtgcactcttgtatgtgtatgagtgtatgtatgtgtgtgtgcagttgcatgtgtgggagtggggatgcacgtgtgtgtttggtgtgtgtatatgagcatgtgtgagtatgtgtgtatatgtgtgtgcaattgcatgtgtatgtatgtgtatgtatgtgtgtttgttgtgtggtatgtatatgggcatgtgtgtgtatatatgtgtgtgtgcagttgatgtgtttgggggatacctgtgcttgttgtgtggtatgtgtatgtatgggcatgtgtgtgtatatatgtgtgtgtgcagctgatgtgtgtgtggggatgcatgtgtgtgcattgtgtatatgtgtctgggcatgtgtgtgtatctatgtgtgtgtgcagtttggggatgcatgtgtggtgtgcatatgtatatggacatgtgtgagtatgtgagtatatggtgtatgcataattgtgtgcatatatgtgtgtgtggcatgcatgtgaggcacgtgggggtttgtgtgtgtatgaagaacaaatcatttggaaacaagtatggtgaatccatctaggtagtttggtgtagggttaaaaaatgattataaattttgtgattgattttcttattggtccaaagactgattctggccagtatattctaggactacccttggtggtggtatcatggggataaaaatgtggctttctgagacaacgccttggaagcgtgtcacttgctggaacataggcatctcagtacagcaatatgtagagtagcacgccatgcctgtgggcctttcaaaagtcctcatgtgaacgtgagcctttcttcctgtggtactgatgatcattacgttcacgttgcaaagtctcattagtttgatttttgaacccagttgttggaaaagggtgttgatgtgtcccccagaaatggggaaggtgctgaatggaaacctaacttaatcgtactgtggattgaatgcgttgcctttttaaagaatgtcttggcagttcccgtgattttgtctaactctctggctattttttcctctctggatttagctctaaatcaaaaacccacacacaattactgcacaggggatgacccttctcagaaaaattccaaaacctctggagtagattgggtttttttacccattgagataaagaaggatattacaccatagttttgaattacaatgctgatatcctattcagggcttattaggatataacttgaagtaaatgttgagagtaatcagcaggacattttgaaagaaaagttacagttaacctagatgacagttaaacaattgtttatccccgataactgcattcagatgggccaatagcagaagtcactctgaaattcatgaaagtgtaactaacaggactgtcactactgcaagcagcatatttaatgtttttactgtttttttataaaaaaaggtttctattacagtgttcttgagtattggactaaaatgcaaacgtcacttgtaaatctattcctttgggcttcatgaagatttgaggtaggtgctcaggaagtgaatctccccaagaaactcctctcttagaatacactctgaccccaagcctgttggtagcaagactgcaggagcacatggctttgcaggcagcagaccttggctcatacccaaactccccactcactgaacctgcagcctcccccttccatcttcgacttctttatttggggaacagccacaataatgctggtggctgtagggactggggacaacatatccagcgcagagcttggttttattagagctatttaataaatgatggtcacaaatatgactattaataattagctattaattcaatttacacttggatttaattaataatagtaataagtgggtttattgtcactctaataagaacatatttgcaggctaaaacatcactcccaggaaaatcaccgtgttgacatatttatcttttcttaacattttcttctaccaataacgcagtgtaagaatcaaccttaatagatcactcactttgtgccaagctctgttctaagcactctgaaaatattaacatatgcaattatcgtagccatcccacgaggtaaccattgttatcccatttttccacgtgaggacactgtggtaggttaagacacttgatgaaagctggtaagtggtagagatatataactgttaagtaacaagaacacaattttatttcttattttatttatttatttatttatttatttatttatttatttattttttggagacagagtcttgctctgtcacccaggctggcacacagtggcacaatcttggctcactgcaacctccgcctcccaggttcaagcaattctcctgcctcagcttcccaaggagctgggattacaggcgtgcaccaccacggccagctaattttagtatttttagtagagacggggtttcactatgttggccaggcggctcttaaactcctgacctcaagtgatccgcccgcttcgacctcccctaatgccaggattacaggcataagccgctgcgcccagcctaagaacacaattttaaatgccaggattcatacctctaaataaaatgggtgcatcctctacaaggcccaggatgtggtgggctctccctgggctgtgactgtgtcttccttgaattgtcttcagaatcattgataagtcccacgcctctgtttcctatctccattgtcacagctgatttatgaacacaaacagtattgcaaaacttaacaccaccactgtttgttgtaaatttacataccttgtgactcatttttaaaaaatcaaatatagcaacaaagtacaaagatttaccaccactgactatgtaagagaaggcactaggagatcttaggatattatgctaagtggtatttcaaaggcattttgtatcttagtataagatctctggtgtgcaattttgtgtgatttgaatagggcctactttgcaaggggccacgcagacggatttcagcatcagaattgatttataccagtagcctcttctttatggtcataccacatatttagaatttgaactttctctgatgcagtagactgcatcttgctacctgagaaagatacaaaccaccctcatcttggcctgaaaagagcctctcccagatgctcagcatccagtacagggaagaagatgatatggtatggggggtttggagccaaaaattgatttgagacatgggtctttgtgactctagcttagtgacttaacctttcaacacctctgtttcctcccctgtccaatggggagattgacctcacctgagagagtgtcctgagaaccaagtgtaatgatgtgtgttgaggggtggggacagggctggcacagtgcctggcatgttctaaccatctataattttattcttttttcccctccctattccattctctctgtggccccatagagaagactccaatctgtggttttcattgatggtggcagctttagccaggcagtggtttccctgttgtacaattcaatagcctgcatgcagggacatgcttctcaggtggcctctggatacacgtgtcctttgtggcctacagaagactttcttacacagtgcactgttaactgagcagaggcagccgtacctggggtgctgattagcactgtgcaatgtactgattggtactgtgtaatttttaggacctccttttgttccctacgccccttgggagagtgtggcacactggaagaaagacacgctgtatcctgggcacaggtcttctgttagactcaatggtgggaaggggatgggatgcagcccagggcctccctgcccatggcattttctcaggagctgtctcctttgagttgctatcaaatcgcatatgttgcatgcttacttgaaaggaatttgcacagagtggtttgtttatactagttaggcatcaaaaagaccattgttctcccagactttcagtataacaaacaaatttaaaaaaagtatgtatatttgggtagataaatatagggttgattcctaaagggtttagaaataaccacaaataggcccatttataacaagaggttgaaggagagattgccactctttggagccacatctgaatgccagaagttcccttgacatcctgctcagtccaagggtcacaacatgtctgatgcctagctctggactcaagggcatcagacatcagaacacgtctctctctggactcagggacaatacccatacatatctgtggaatcaggataccttacctcctatctccagttcctaccccactgtgaagctcagagtgatattgagtgagccctttctgaatcgggaccagtctcatctcagcttattacccgtgggccccagtaatgcaatctgttcaccttctgaacactgggatccccgttgtcttgtcctaggtcactcatttgagagacagaagcgagtagaggctgtaagcatgaactctgcagccacagggttgctttgaatcctggacttgacacagctgtgtaaacttgagcaagttattgcaactctgtgtgcctcagtttacctatctgtaaagtgaggatacaaatgatctacttcatagggctattttaaaaatagttaatatgtaagtaactattagaatgcctagaacacggtacttgttagtaagagttattcattgtcatcatcatagtcattatcatcatcatcatcaagaatttgatgagtacctgtaaaggctaagcaatatccgaggctcatggggtacacagcaataaactaggcagggctctgttctttgagaaacttactctttatttgagacaaacaataaagagagctcttttagcacaaggcactgtaggaattccagtaacaaggagtcgtcctatgtagacagaacttgtgcatcgttgatgatctcgacgatcttgctaaattgaagcttggatgggcaagtaagactcagactttactccaagcaattccaagcatatgaaagcacgatgggcagatattagcctgccatccatacacagtattggatatcgcactctctgtgggacatttgctccttattctgacatcataagaacagaaaaccagtgcttctggacacgaatcatttcagggctctttgcagatgcatagcatgaaagcagctgtttcagaattcaaaaattatacatcatgccgtatatggcttttcgctttacaagttgctttcaaacattgcctcatgttggcctcatgacatccatgttagataagcgtggtgagaattacttccctgtttgataaacggggaagctgagtcagggggagctgcctcatcatggtcactaaagagaggcgagtgagacctggaaccccactgggtcttctgtcttctgggtgagctcttggttgaggggactgtgagatgcctgtgtaggtgagtctttgctgatttatagactcaatggactaattgttgctggatgctaccagaactatgaaacaatctgcaggacgaaaaagcagatgagtcatgcaaattttaacaaattagttatgtttctgaaattaaaagtaggtaaagaacacaaaagaattggaaacaaggactcagatacttatatgcctatgttctttgcagcattaacaataaccaaaagggggaaacaacccaagtgtctatcaactgatggatggatcaataaaatgtggtatatccgtacaatggaatattattcagccttaaaaagaaatgaagttctgatacatgttacaacatggatcaatcttgaaaacactatgccagagactgggcgcgttggcttacgcccgtaatcccagcactttgggaggccgagacaggctgatcacttgaggtcaggagttcaagaccagcctgaccaagatggtgaaaccctgtctctactaaaaatacaaaaattagccgggcgtggtggtgtgcacctgtaaccccagctacttgggaggccaaggcaggagaattgcttgaacacaggaggtggaggttgcagtgagcaaagactgggccactgcactccagcctgggtgacagagcgagacttcatctcaaaacaaaacaaaacaaaacaaaaacattatgccaaatgacataaactgaacaaaaaggacaaatactgtatgaatccatttatgtgaaacatctaggttagctaacctcatagagacagaaaatagattagaggttaccagaggccagagggaggagaaatagacatgtattgcttaatgactacaaaattgctgtttggtgtgaggaaaagttttgaatatagatgttggcaatggttgcacaatattgtgaatgcatttattgccactgaattaaacactgaattaaaactgcttttatattttaattatacactgaaataaaactgcttttaactagtttattttaattatacactgaattaaaactgctttttactagttttatcatatatcatactagtttgttgttgttgttgttgttttgagatggagttttgctcttgtcacccaggctggagtgcagtggcgcagtcttggctcattgcaacctccacctcccaggttcaagcgattctcctgcctcagcctcccaagtagcttggataacaggcacccgccaccacacttggctaatgtttgcattattagtagagacggggtttcaccgtgttggccaggctggtctcaaactcctgacttcaggtgatctgcccaccttggcctcacaaaaagctaggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaagcttattctatttccctgagaaaaggtattgatatcacaatgcagaggtgatcttattttaatttcagcactattactgctgtgcatttattacaatcaggcagagtactgatgtgtttcgaatacgggaaagacagaatctgaaaagagatagcaatttaactttctgcaggaaaactccggcgtgtttttcattctgacaacttgactggtgataagaaagatgaggtactacttttgtaaacttgttatccttacactctcaagaaccatttgtcatccatttttccctgtcatactgaaatatacctctaagaaaatatcggtaatttctcagtattttaaaaacatagattctcttgatcagtctactaaatatttcatagtttgtgtgttgttcattagaaaagaagagattccattttcccaaactgtggaactgagcagcgcactgagattttaaggagtgggatgtgggtaccctgagaagggacatggttttgtccagagctgaggaaaagaaaaattgaccccgagatcccagcttagccaacagccctgggcaatttcatcagcttcctatatctcggtgtagccacgagcaagatcattttgtggcactgaactcacggtctgcaactcatgtgcattcaggacagacattgaggcttagggtcaggctgtaggtggcaccagccatcatgggacattcagaccagagaatgcagcaaccaagagcttgcttaggtaggcaagcaggagcgtttgtccactccatagccagccttcatctatcaggggacttgaaatgttcattgcacattcccctgtaggcaagagtatttattgagaagacctgaattttaatgcaaagctttccaaatggttgtttgtagccagttgacctttgagtccagacatcaggtggctccattcctctccagggccatggagcttcactgtgaccttgggggactgtccagccctctccatagtgttgagggagcagctccagctcttctcccctcactcttcctggcctccctggggccagtatcccattgttaacaccagcaccagtcccatgcctatgatttcttcttttttttttttttttcttttgagacagtctcactctgtcacccaggctgaagtgcagtggagctatcttggctcattgcgacctccacctcctgggttcaaggaattctgcctcagcctcccgagtagctggaatcacaagcatgcactaccatgcccggctaatttttgtatgtttagtagagacaggggttcaccatgttggccagactggtcctaaactcctgacctcaagtgacccacccacctcggccttaaactgctgggattacaggtgtgagccaccgtgcctggcctatgcctgtgattgctttacttcagaaaagaaagcatgcagtgtctgacttctgagcaaagctgtggctcccaacaggaagacatcttacaaacgcaggagagatgcaagctcacttagaaggggaaacgtgcttagttaatgccagggttcacatgtgaccatgtttaaaatgaccacagagggaaggagaacaaaaaagcaaactttgctgacactcaaatgttttctgtttctaagtggatgaccctgcctttctagatacaacgggtttcattcttcatgctgggcaggttgccggggtttggacaaatcctgctcagtgcaaagcatctcccaaggtaacagtccctgctggctgctttaggtaaatgtcagcttgttatgctgctggacagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgatgggccagcagaaggggctcttgtcaaatcccactttccctgattaaaccggaacaggaatgtctggcagagtagaaaatccagggaggagaggtgaggcctgcatcctggagggaaggttgtcctgagatgttcctgccatttttgtccccaaaagcgggatgatactagaggcgatggggcaggatccatcctgaatgtgtccggagagttttggaagatttgaccatcactgcaatagtctttcttctacagaaaataagtccggtaaaaatggggcaaaagttactcccacccagaggaatgagacatatgtgtccccctaccgaggggtgccccagagagtgggcacctagaagatctggttgttccccgcagtcacatacctccctgaattgaagtccttagagccacagaaaacttcctctggttttcttactagttactgttggagagagggtcattcctgattcctcctccagtgcagcctggcaggggagcctgctgagctctgctgtgtgaactttctgcccagagacaaggacagggatgagaggaggcagcaggtgagcagaagacaagacactggaagataagacctgtgcatcaggaccgagggaatatatgtgggagagacagagtccactgagatgcctcagctacccagggttcccactgtaaggaagccaccagtgtccagaggactccaggaaaaactcggatcccactttctgctactgaccagctgtgtgacctcagaccaggagtgcaatctctctgcacatctgacatctgtgtcaattcttccttaggagaggagagacgatttatgccttacccacttcttaaggcagtgttgaacaatgtcatcatgtgtaaaagcattttttaaaataagctgttgtctgcatggaggccatgattcatataaagcaatttgatttatacaatgaatctctccaagttttgctccttgcaaggttctgtgtcaataaatgttcaaacccatatttattgagcacctactataaataatcaggcgctgttttaagcacttctgatatgctggtaaaaaaaaacagatgcaaatacctgcctttgttacgctgacattctagaggacatttaaagagatctagttccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaagaaagagaaaaaaataccatgagagaagggggatgctggtgaaggtaaaatgttagtggagaggtagatttcaaatagaatcgcctaggttgaaaataaaaagcagtcatcaactatgatggaaaaatatttccgagacttgataagtcatccggaccctggctgctcactcccagggttgcgtgggatcctttgcaggatgagcagaggctgtcagtgtgggatgcgtaacacagcaggcacagggtaactgatctaattatgaagagcccttcccatctgatcctgactttgacctatggcttgtgaggccccagcaacattgaatccagggtgaaagtcagaaggactaggacccactcagctagttcaatcctctcatgccttcagtggctggagatatttagggagcacatcctatatgctaagccctaaataaggtgtcaggaatatagcagtgaactaggatggcaggtcccttccccaatgaaacccagtgtgggacaaaatgtgatcctggaaggtgagggtgattctgcaactcataaataaactgcgtgtgccagtagcaggccttgtggtaacacctaggcaggaccaccttctctgcacaacttcagagagcataacttaatttttacacattgaattttgatgtatttatttgtcattgcctaacatcccaaccccagcgtctgatggggatggcagtcctggcgttatgccatgggtagggtactgaggctagattccctgaatcctgaccgagtctcatcccatgagccagggtgatgaggctaatcaaacaaggaaccaaggagcccataggttgaaatacaaggtttggaagaaaatgtgatgcttgctggaatgaccagatgggcgaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgttgctgcagccaaacgtctctaaagaaaatgatcaaattgtaattggtcaacatgttctctcaatgataccttgatacatcattttaattttaagtttttattcatctctaatgttttacttcaggcacttcttatttctttcttggaccattccaaaaatgtcctaaactggtatctcggccccagtccatcttctacgctctgaaaaaatacctttggttttatttttgcagagtcgattttttcccttcgtggatgggctccttggcaatctgagccttcgccctgctccctgccacccccctgccttgcactccaggcatgcacattcatgaaaattcctcaaaatcttagggaggctgaggcaggagaatcccttggacccgggaggtggaggttgcagtgagccgagattgcaccattgaacgcactgtagcctgtgtgacaagagcaaaactctgtctccaaaaaaaaaaaaaaaattccctcttgctcatgactcatttgtatgtgatgttccacttggcagccattttcctctagtccactggcccctggtgttcccgcggggcttcttacatgagccattctagaatcgcaggtcccttgctcttcctctgcacatgcctgtgtttatctggagagagtctgtttgtttccctgtttgccttcttaccagacttggagcccttcaaagccaagggctgtcccatatggatagaccttccccagtgtctaaataggaactgggatatgatagatgttcaataaaaattaaacaagagacaaaacaaaagtagggaccaatctggaatccagtaaccatctctcatttcaggagaagtggaaactctcaggaagttgaaaatactgggcttcagaacctgacctagtttgcagccaccgctcccctccaaaaacaatcccataagaattccttctgacccctgagatgagagggtcactgaggtggatcctggccttggaaatccctgttaggacctattgggaccttttacttgcccatcaccaccaccctaacattacattagaaaccaacttgggcttgaaatggaggcctctgagtttgcatgaaccccaaaatgcaggctcagattggtttcattgcaaaaagggaagttgcattccagttatctctgaataaaacttgtgatggtaaggacacagcccctacccctagaagtgaaaactggcaagtctccaggaaccaagaccactccaaggtccagttcttgcatcagcgaggccttgcttccttcttgcttcttaacaactggattccatgctcactcacggcttctcctctctctacctctggaatgtgcattgctgtcagagctgctttgtaatggctgcgtcctcatagcctagactctctctcctgagctttgaagcttcagtctgccctgctagccactaacagactcctgaatttctaagttcaggttcctacaatggaaaataagattgacctgactcatttcttcatgtggaatttttggctacagattggctgttgtttggtcaggccacaaaccccggtccaattgaccatgttttaccatattctcatcttgtccttagaaggttgcacagaggtgagttactgaccagaatgaacctaggcatggacatttaggaatttcctattaaacataaacacttcagagaagaaaagcatattccatcttaatacctcagaataaaggagcgtatcagcttcattccttttcagaggtacagcaggaatctatacacatcagggggccagttaatctgaaggatgagggggacgtctgaaagcagatgaggagaggaaaggaagaaggtagccctgaacctctgaactatgttcctggatctcgtcaatttagtccttactctctgtcaagttgatccattgacagattctcaaaaccaggtcaatatagagatatggcactcttacgtcttgtgtcagctgtatctgttatcaatagttttatgaatggcaccaccgacaaaggataaaaacctaactgcgattaggcaaggaaaatatatatataccagattttctggtcccccacaagtttcaccctagtgactgttctctgtcatcccacgcagggtgggctttgagaactcatcaatcctcttgtgagtttcagtcttgcatcttttctgggatctggctcaaacgtggctaatttcccagcatactatgttcagtacaagggcaatctgtcagcattcgtctgagcatgtttgtaaagacacataattcactatgaaaccaattcatttcagatgtgctttttcccattgcaccaaagccccgggttgatttggcagtttggtatattatacaaataaatatgtcgaaaatgggaagttaacaactgttggaacctgaggtttctgaaggacttggctctggtgtcaacttcagaaggtcatctggagaagctaagggatctgaacattcttaaaaggaagagaaatgctttagaataaaaggaatcctgtgtccacaggcaggcagagtctcgtttttgatttcctagggaacttagcacagtggagttccaatagctcataggaaatcgcgtttcacaaaagttacacaaaacaatacctttctgaggagtttatgttctaataggaaatacctaaaatatatttatccactttttaaattttattctaccttctctcttttaacactgatttacataataagggacagattaaattaatttcataatagaaatcttgggctttaaaaattatcttagaaaggtaattgtcttcatttggtgttttatgttccctaagtagttatctttgctgtttcttgtgggggttgctggcaattctgacttcccattccatatctcatttattacttcatttaggaaatactctttttttaatttgataggctgaggtctatttcctaatgactttcacctagttttaattttcagcaaaagaaacacttaagatataagtcataggtaatacttaggcctgtctgatgaatgacggaatctagcttccgctggtatttcatctttgacttctaacatgtaagaagccttcactttagtggtcatctctcctcctttttcgtccttgctcctttcagaagtgttcatctgtagcgtaggattcagtgatccccaagtgttttaagctgcagagctctttgttccgatgcttgtaattcacataaaggagataaaagtggagctgtgtgggctgaaggatgagaaggggagaggggggaaatggagccccaagttctagacaagcctccccccatcaactccttcatcctggcagcctaggaaaggttactctagcacaatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgttaaatggtttgagtttatacatggatgccttatgtgttttgtgcgtatttacatttatatttagattcctcttttttcttaagtactgtgtctatgttccctccctgttgctctgtgtacacataatcgattgcttattgctctgtgtatgcataaacagttgcttcttttttttttttttttttgagacagagtctctctctgtcacccaggctggagtgcagtggtgctatctcggctcactgcaagctctacctcccaggttcacgccattctcctgcctcagcctcccgagcagctgagactacaggcacctgccaccatgctggctaattttttgtattttttagtaaagacggggtttcaccatgttagccaggatggtctcaatctcgtgaccttgtgatccgcctgcctcggcctcgcaaagtgctgggatgacaggcgtgagccaccgcgcccggctgccgttgcttctaattgctgcttagccttgcatggttgcatccagtctgttccacaaggatggacacccaggttgcctccacactatccccatagtccatcttcttgtaattcttaagataggaccaaaagacatttatttacaagtttccctcttctattagacggtgagacagtgagagaagatttcctgactttatatacaaagcagctagcacatagcagtttctcagtaaacacaaagccattggcttcccaggcagctggacacatgggctcaggcccagcctcctgtgtccttggttcccaggaaaagtgacagccttaacggcagcactgtgattaccgttatcttgtcatgaaggtttatgacgagtaagggaagtgccttttaggaagagaaaagatgaaaagccttcccatgtgacgtatactagaattccctgaaacctgaaggccccacatgatgcacctgtttattcaaacacatacatttgagtactaactgtaagtgatagtgggtatggatttggtgaactctttgaatgctttcagcatttccccaatctgtaggagattctagttccttagaattggatactgagccctgtttgatgaaacttgctgtggcatttggagaggatgcagctagggttcacacatttaaccatggatggatctgtcagtcagtctcagttcatggtagacaagaaaggagatacatgctgacaagccgtgtaggaagtgtactgccttaagcagtgtaaacatctttattcctgaaaggcatatctgctaggttgattgtgaaatgtattctgtttttttttttttgttttgtttttctatttggagggtgagggatagcctactttaatatcagaagattttttttttattgaattgtggtactgagtgaaatgacctacctttacttgacctgcaacagagttgctgtagaccaggggtgggcaaattctttctgcaagaaccaggtaataagtattttacactttacggctacatggcctttgtcaaacctgtcacctctcctgttgtggtacataggcagccattagacagtctataagtaaatgggcttagctgcattccaataaaactttattcacaaaataagaagggggccaggtttggcccatgagccctggttttcctacccttgtttagatgctcatgcacttgctacacctggaaatcaacataaatatagtaggtccaataaggcaaaccagctactgtttcttgccagtattctctgctctctcttcaggacactctgaacacaatggataggagtaatatgaacagaaaacagaagaaggacttggactgtatcaattttggcttggttgtgcacgccagaaaacctaaaataacagtgcccagtacacagcagaagtttatttctctttcttgtaaatacagtttggagacaagcagtccagggatagcatggctcctcttctcacaaaagcctctgctccttctattatgttttctcccacgaagggtttggtctcatggttccagattgtagcaagcattccagataggcagatgggaaaaggcgggaaggagagggagagtaaatgaagagcgtgcacgctgacagatgctgcgacgagcttttccagttgctgcctgtcatggttagttttaggtgtcagcttggctaggccacggtacccagcttcttctcaaacaccaggcgacatgttgctgtggagttttgttttgaagatgtgattgataattcagttagcggacatggagtagagcaggtccccctctaccatgtgggtgggcctcgtccgattagttgaaggctttaggagaaaataatgaggtctcccagggaggaaaggattctgcctccagacagccttcaggcttgagccaccatcccaactcttccccgggtttccagccagctgccctgccctgcagacttcacatctgccagcccccacaatccaccatccttaaaaatctgtctctctctctccacacacacacatacacacactattggttgtgcatctctggagacccctgctgcgtgtgcagcctattcatctagaaggctccggggcagtgggggatctactccttatccacagcattctaatattctggagacacaagagaagggacatggaagggcaggcagacattaaactacccagaagcgatgtgtgcctgtgctcttattgcacctccacattcttatttttcttactaataaagaatttaaaatgaaggaagccccagatcacccgggtgtgattctctagccttttcccacttctagttcaagagatgtacccgtgttcttttaaccaaagaaaaaatcattgcatcctttactctagcagtagtgcctgaagcatggggtgaaggtgatgagtgcgttagggcctttgggaactctgtcccagccaaccctcaccgtccataccctgctgggagggaaagctgtggccccggcagctctcttggtttatactcccaagaggaaactcttcctctcgaagcctgggggagggacagactttggaccaagttcactctcccagctataatttgaagtgtggacaaaatgggcccagatgttcagccttgcttgttgggcctggctctggtctgcgttctcatccgcgagaccctcggcctccctgcccacaccaactcgccttgggtcttctttgagacattcttactgaacaagaaataattccccagggttagattactggacacaggagaaatgtgttctgcaagctgaggagaattgaatttggcttcagggacttcctcctccccaggtgaggtttaccagtctgtaaggatctcacaggtgatttgggtccatttttggtgcactttatttctcttcctagaccctttcctctgtcttcccagacccttcccctcaaaggggtgctggcgttgggttgcccacggctccttgccccggtgagccctgaccacgcagacccagcagcttccagggacctcagcatttaagtaatgggcgtgcaagagaaaaccaaaaccaaacccaaacaagcctccaaatgcagggagaactcctcagtgggagctggagagttctagttgaaatgtctgaggtgacagtgagcacgcagtggtcgactgtcggaaagctggtcctcaggccagaaaactcatccacagttccatcccaacttggtctttttgtatgagttgaagaaaaagtgtgggttttttgttgttgttgtttctttctttccaactagtttctttggatcctggcatgactccagaagaatcgtaccctgctgccccacattcatttttatttttaggggattgtaagttagaagaagtgacttctcttgcagatggcaaagacttacaatccaaaatcatcacaactcacaatttaaagacattttgatctctaccttcctgagcaaatcagccggcaggcctatttcttgtagggctttcgtctgcacatagtaggtcctggataaacacttgctgattaaatgatattcgaagcaaagcgactgcagctgattgtctacttagggcaaggtgagtgtaaatcagaagggtgagaaattgcatcaggctgcggagggatgcaggcttgcacggctacaaacaaacctaattagctgtgcctctgccagcagccctactcagacacatctggaggggggagaatggctaaggctagattggctttcccaagtgaaaacgcctctcttcagttgcacctgcacaggactgattgcgcctcaaatccatttgtcaggctggttgcaggtatctgagaaattgctaatagaattgggcaaaagtgcccgtgggagtgggaggtaaatagcatggcaagacaagcggctgctggagtcccgggttggcaggtgggcctgcccccatgccccgccaggctccagggggtacctatgcccagtgactacagagaagacccgtcttggctgagcatcaggctctggtgcagtctttgctaagtgtgtttatcggccaccacgagagtacttagctgcaaaatggaggtgctttcactcacagacaccaggagccttcactagggaggcactgagatcagcactttttccaagatgctccttgcaaggtacttgtgctccatcaaattgcaattcttcctagacacaaagggaggcactggcccagagtcaaggtcatagcaagaccccttgagctgcctgtttcttagcagaagctggagtagacagacatgacttgagacgtcttaaacttgtttggagaatttgggactggatctcccgcccaagcactttggaggggtctgaagagacacaggacgtgtgtatacgtgtgtggggatttggggctgtgtgtgtgtggggttggggcaagggcttggatcaaacatctggatatgaataccaactctgctgttttctgctgactgtgaacttggaagagtttcttatcagttcaagcctcacttccctcataaatgaaatggggatagtaatcattattatgggctgttgggtcccccaaaaatccatgtgttgaagtcttaacacccagtgcttcagaatgtgatgatatttggagatacggtctttaaagaggtgaatcaagttaaaatgaggtcctatgggtgggccctaatttaatatggctgatgtccttataagaagagagattaggacacagacacacacaggcgatgttatatggtggtttagggtctagactgccaaggttcaagttctgctgtgacttacttgctctgagtgaccttgggtttcatattaaattttctgaatatcaatttcctcacctgtaaaatgggggaaataacagtctgcctcatggtgttgctggaggtgtgaggtcagatattaaccatctggcacttccaccgctgcaggtagcttggccattgttattgttatgattaagggcaggtgagcatgtagtgtctttctttgctaagtatgtctgatgccaagtcagtattcattgagcacctcttctgtgcaaggcgcttggaaaggagtgcagtggctctttttccccactcttgcccctgctagattcatcctcaagtcttctctgagttgcttttcctgcagcccgtagttactgaaaaccataatacttatagatgctgctttctagaaatgagcctgtaaagtcttgtattttctcttggtctgcacaactttagggggggtaacacgtcctgtatttgccagttgttaaccttctctttgaccacggagctctagatgatggcaccgataatgcccaggcagatttagttttgatctccaatgaaagataggcctttctgtatttgcagtaataagcaaacacctttagcttgagaggataaacttaagtacaatgtttgttctctggaggcatactgattaactttaaaatatgaataaaaggcagtcctatttcattatggtaagaacacttaatacaagatctgccctctttttttttttttttttttttttttttgttggagacagagctctcacccgggctgtcacccagctctgtcacccaggctggagtgcagtggtgcaatctcggctcactgcaacctccacctcccaggttcaagtgatcctcctgcctcagcctcccgagcagctaggactacaggagcgtgacaccacgcccggctaattttttgcatttttagcagagacggggtttcaccatgttagccaggatggtctcgatctcctgacctcgtgatctaccctcttaacggatttttagtgtgcaagttatctgtaggtacaaggttgtacagcagatctgtcaaacttattcatctcacataattgagactttatgcctttcaattagcaactcctcacctcccgctcccaccagtcccaggcaaccactaccctgttccttttgcctccgtgagtttggctactttcaaagcctcatagaagtggaactgtgccgcatttgttcttctgtgcctggctcatttctcttggcatctttcctccaggttcattcatgctgtcaccaatggcaggatatctcgctcttttgtttttaaaaacagccaaagtcaagtatgtaaaaaggtgggcagctgagaacctggtaccagaatgttccaaggaaaggtactgagtggcacaacctggcctggttctccaccagtaattcctaaacttccccacctggaggctcctgatgacagatgggtgaatggcagagtagatgagtgagggaggtggggagccccggtggggcctggctggtcaaagtccaagcaatctgatcccagcaggacattcctttgaaggatcatgtatcactttacaaatatccacaagctttgcactctatccatatttgtttaggtgtaaaaaaatattttaagctctttactgagaaggaaaatgggatgcacccacatggattccccagcatgcaccgctgagcattccctgtggtaccgctcctcagtttagggtttaggtcaggggccctggaatcattgaaggagacctgtcttcctctcgtctgctgtcttcctcctggatatcacccctgggtcaagcccatggtctcagtgggttagcaatgaatccttcctaagatgcgaacagatgggagctcaacatttgacccatccctggggttttagtttttttgtttgtttgtttgttttgagacggagtcttgccctgtcacccaggctggagtgcaatggcaccatctcagctcactgcaacttccgcccctcaggttcaagcgattctcctgccttagcctctcaagtagctgggattacaggcatgcgccgccacgcccagctaattggggttttaggtttaagaggaatcccagaaggacagggtgatctgaggtcctgagcaactctgaggctgaaactgcgctggtctactttaaggcaggggctgtgattttccctgtgactgaggtcctccaggggtcaactgcatttcaggtgtgtgaggggagagtgactgcccacctggctacccagcccttctttctgagcctgtttactcagctgctggggcctccatgacaggtttgcttggtgaccttacaccgcagtggctcccagggccagagacgtgaccaaggagggaccttgcactgaggaacctgtgaccgtaggaagaccctctaaggccgactcttgcttggcccggcccagtccctcctaccaacactgataagaacttaggttcctagcatcccaggaggcagggtcacaaagacaagctgagaactgataccactgctatacccacccctggacctccctgtcccatgcaggagtctaagccagtgcaaccaaggccaagcacacacccataccacacagcaagggtttcacacggggttttcatttctttacccctggccgaaccatgcaagctaccagccatctacccagacttcttagagtctgccaaatacgtactcagaccagaattaagttcaggccatggtagaggtgaccagccactctgccgtgacctggattcagccatcaattccaaagaagcccacagtgccttgcattttgctggctggtttgtttttgtaaaatgatggggtgggaagcagtgctgggcattggaaaggggctgaacaaggggaaatcttcaacaccttttaaatggaagcatgtctagttggcctcttttctgtaaggaactatactgggcatcacagagatgcaaagactagagtgactgattcaggccctggcctgaaggactttattattgagagttccccgtatatataaatggctgaactctcaggccagtgaatgcctgtgaccaagtgccaatgggtgaaagtagaggttccagaccaggagtgggaaatgcatcaacagagagcttggccacatgctggcctggagtgcagagaaagagtgccaggcctctgggcactgagttctgagctgcttctggagggccaggagatactcccacctgcaaatgactggctgattgcactttccttagagtttgccacctgcatttccgctctacccactaactgactgctccggtgcagggagccaggcaggggcagtggtacctgggtcaggacacgacagcagcctctggcctcaggcagggagtgctggacagtccgtctcctgtcctgctttgtctctttctccttgagctcaggacacagtggggagccctcatgtttctgtaaggtcatcacacaggctggaatgttttttttttcctctctctctctccctgtctttcttttaatggacaaacacccttgaggtcctggttgattttcttagagaaatgtagattctttgattctaacgatggaacataagttttctgaattttgaggaaaacaaagcccaagatttcaacaaccagtgttcctgccaaatccactgggcaaacagaaaagctgcctgcctccggtgctcccagacccccttccttctcaaacacgcatcagacactttgcaccaagaaaaaacaaagggcatccctcctggggccacctctgccccctgtccaggtacgcgctgtctggcgcgccctgcgtgggggccgcaggttcagacacccgggcgcggcgcggggccctgatggatgcggtgaccgaggctgtggctgcgggcgcggcgtctccgcggcagtcgctgcctccgcggccccctccccagccccagccccagccccagccccagccccagccccagccccagccccagccccagccccagcccggctgagcgggcggccggagcatgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca
